(12) United States Patent
Zhang et al.

(10) Patent No.: US 9,984,201 B2
(45) Date of Patent: May 29, 2018

(54) METHOD AND SYSTEM FOR DETERMINING CANCER STATUS

(71) Applicants: The Regents of the University of California, Oakland, CA (US); YouHealth Biotech, Limited, Grand Cayman (KY)

(72) Inventors: Kang Zhang, La Jolla, CA (US); Rui Hou, Shenyang (CN); Lianghong Zheng, Shenyang (CN)

(73) Assignees: YOUHEALTH BIOTECH, LIMITED, Grand Cayman (KY); THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 66 days.

(21) Appl. No.: 14/986,520

(22) Filed: Dec. 31, 2015

(65) Prior Publication Data
US 2016/0210403 A1    Jul. 21, 2016

Related U.S. Application Data

(60) Provisional application No. 62/104,785, filed on Jan. 18, 2015.

(51) Int. Cl.
| | |
|---|---|
| G01N 33/48 | (2006.01) |
| G06F 19/22 | (2011.01) |
| G06F 19/20 | (2011.01) |
| G06F 19/24 | (2011.01) |
| G06F 19/28 | (2011.01) |
| G06G 7/58 | (2006.01) |

(52) U.S. Cl.
CPC ............. *G06F 19/22* (2013.01); *G06F 19/20* (2013.01); *G06F 19/24* (2013.01); *G06F 19/28* (2013.01)

(58) Field of Classification Search
CPC .......... G06F 19/22; G06F 19/20; G06F 19/24; G06F 19/28
See application file for complete search history.

(56) References Cited

U.S. PATENT DOCUMENTS

| | | | |
|---|---|---|---|
| 4,683,202 A | 7/1987 | Mullis | |
| 5,525,462 A | 6/1996 | Takarada et al. | |
| 5,786,146 A | 7/1998 | Herman et al. | |
| 5,972,602 A | 10/1999 | Hyland et al. | |
| 6,017,704 A | 1/2000 | Herman et al. | |
| 6,033,854 A | 3/2000 | Kurnit et al. | |
| 6,114,117 A | 9/2000 | Hepp et al. | |
| 6,127,120 A | 10/2000 | Graham et al. | |
| 6,180,349 B1 | 1/2001 | Ginzinger et al. | |
| 6,200,756 B1 | 3/2001 | Herman et al. | |
| 6,265,171 B1 | 7/2001 | Herman et al. | |
| 6,306,597 B1 | 10/2001 | Macevicz | |
| 6,331,393 B1 | 12/2001 | Laird et al. | |
| 6,344,317 B2 | 2/2002 | Urnovitz | |
| 6,448,001 B2 | 9/2002 | Oku et al. | |
| 6,528,632 B1 | 3/2003 | Catanzariti et al. | |
| 6,797,470 B2 | 9/2004 | Barany et al. | |
| 7,011,944 B2 | 3/2006 | Prudent et al. | |
| 7,037,687 B2 | 5/2006 | Williams et al. | |
| 7,083,917 B2 | 8/2006 | Barany et al. | |
| 7,166,434 B2 | 1/2007 | Barany et al. | |
| 7,169,560 B2 | 1/2007 | Lapidus et al. | |
| 7,186,512 B2 | 3/2007 | Martienssen et al. | |
| 7,232,656 B2 | 6/2007 | Balasubramanian et al. | |
| 7,320,865 B2 | 1/2008 | Barany et al. | |
| 7,332,285 B2 | 2/2008 | Barany et al. | |
| 7,364,858 B2 | 4/2008 | Barany et al. | |
| 7,429,453 B2 | 9/2008 | Barany et al. | |
| 7,459,274 B2 | 12/2008 | Lakey et al. | |
| 7,553,627 B2 | 6/2009 | Laird et al. | |
| 7,598,035 B2 | 10/2009 | Macevicz | |
| 7,611,869 B2 | 11/2009 | Fan | |
| 7,645,596 B2 | 1/2010 | Williams et al. | |
| 7,700,324 B1 | 4/2010 | Issa et al. | |
| 7,769,400 B2 | 8/2010 | Backholm et al. | |
| 7,901,880 B2 | 3/2011 | Jeddeloh et al. | |
| 7,910,296 B2 | 3/2011 | Jeddeloh et al. | |
| 8,323,890 B2 | 12/2012 | Laird et al. | |
| 2005/0069879 A1 | 3/2005 | Berlin | |
| 2009/0155791 A1 | 6/2009 | Wojdacz et al. | |
| 2010/0144836 A1 | 6/2010 | Van Engeland et al. | |
| 2014/0080715 A1 | 3/2014 | Lo et al. | |
| 2014/0094380 A1 | 4/2014 | Sherlock et al. | |

FOREIGN PATENT DOCUMENTS

| | | |
|---|---|---|
| TW | I454578 B | 10/2014 |
| WO | WO-03064701 A2 | 8/2003 |
| WO | WO-2005012578 A1 | 2/2005 |

(Continued)

OTHER PUBLICATIONS

Abbruzzese et al. Analysis of a diagnostic strategy for patients with suspected tumors of unknown origin. J Clin Oncol 13:2094-2103 (1995).

Abdi et al. Principal component analysis. Wiley Interdisciplinary Reviews: Computational Statistics 2(4):433-459 (2010).

Acevedo et al. Analysis of the mechanisms mediating tumor-specific changes in gene expression in human liver tumors. Cancer Res. 68:2641-2651 (2008).

Akbani et al. A pan-cancer proteomic perspective on The Cancer Genome Atlas. Nat Commun 5:3887 (2014).

(Continued)

*Primary Examiner* — Eric S Dejong
(74) *Attorney, Agent, or Firm* — Wilson Sonsini Goodrich & Rosati

(57) ABSTRACT

Disclosed herein are methods, systems, platforms, non-transitory computer-readable medium, services, and kits for determining a cancer type in an individual. Also described herein include methods, systems, platforms, non-transitory computer-readable medium, and compositions for generating a CpG methylation profile database.

17 Claims, 56 Drawing Sheets

(25 of 56 Drawing Sheet(s) Filed in Color)

(56) References Cited

FOREIGN PATENT DOCUMENTS

| WO | WO-2005019477 A2 | 3/2005 |
|---|---|---|
| WO | WO-2005111209 A1 | 11/2005 |
| WO | WO-2006056480 A2 | 6/2006 |
| WO | WO-2009021141 A1 | 2/2009 |
| WO | WO-2009049916 A2 | 4/2009 |
| WO | WO-2012031329 A1 | 3/2012 |
| WO | WO-2012104642 A1 | 8/2012 |
| WO | WO-2012149171 A1 | 11/2012 |
| WO | WO-2016115530 A1 | 7/2016 |

OTHER PUBLICATIONS

Baldi et al. Neural networks and principal component analysis: Learning from examples without local minima. Neural networks 2(1):53-58 (1989).
Balic et al. High quality assessment of DNA methylation in archival tissues from colorectal cancer patients using quantitative high-resolution melting analysis. J. Mol. Diagn. 11:102-108 (2009).
Ball et al. Targeted and genome-scale strategies reveal gene-body methylation signatures in human cells. Nat. Biotechnol 27:361-368 (2009).
Benjamin et al. Controlling the false discovery rate: a practical and powerful approach to multiple testing. Journal of the Royal Statistical Society. Series B (Methodological). pp. 289-300 (1995).
Best et al. RNA-Seq of Tumor-Educated Platelets Enables Blood-Based Pan-Cancer, Multiclass, and Molecular Pathway Cancer Diagnostics. Cancer cell 28:666-676 (2015).
Bettegowda et al. Detection of Circulating Tumor DNA in Early- and Late-Stage Human Malignancies. Sci. Transl. Med. 6(224):224ra24 (2014).
Bhardwaj et al. Kernel-based machine learning protocol for predicting DNA-binding proteins. Nucleic Acids Res 33(20):6486-6493 (2005).
Bibkova et al. High-throughput DNA methylation profiling using universal bead arrays. Genome Res. 16:383-393 (2006).
Bo et al. New feature subset selection procedures for classification of expression profiles. Genome Biology 3(4):research0017.1-0017.11 (2002).
Brat et al. Comprehensive, integrative genomic analysis of diffuse lower-grade gliomas. N Engl J Med 372(26):2481-2498 (2015).
Breiman. Random Forests. Machine Learning 45:5-32 (2001).
Candiloro et al. Assessing combined methylation-sensitive high resolution melting and pyrosequencing for the analysis of heterogeneous DNA methylation. Epigenetics 6(4):500-507 (2011).
Costello et al. Restriction landmark genome scanning. Meth. Mol Biol 200:53-70 (2002).
Cottrell et al. A real-time PCR assay for DNA-methylation using methylation-specific blockers. Nucleic Acids Res. 32:e10 (2004).
Cottrell et al. Discovery and validation of 3 novel DNA methylation markers of prostate cancer prognosis. J. Urology 177:1753-1758 (2007).
Dees et al. MuSiC: identifying mutational significance in cancer genomes. Genome Res 22(8):1589-1598 (2012).
Degraves et al. High-Sensitivity Quantitative PCR Platform. Biotechniques 34(1):106-115 (2003).
Deiman et al. Characteristics and applications of nucleic acid sequence-based amplification (NASBA). Mol. Biotechnol. 20(2):163-179 (2002).
Deng et al. Targeted bisulfite sequencing reveals changes in DNA methylation associated with nuclear reprogramming. Nat. Biotechnol 27:353-360 (2009).
Diep et al. Library-free methylation sequencing with bisulfite padlock probes. Nature Methods 9(3):270-272 (2012).
Dudoit et al. Comparison of Discrimination Methods for the Classification of Tumors Using Gene Expression Data. Journal of the American Statistical Association 97:77-87 (2002).
Eads et al. MethyLight: a high-throughput assay to measure DNA methylation. Nucleic Acid Res. 28:e32 (2000).

Egger et al. Epigenetics in human disease and prospects for epigenetic therapy. Nature 429:457-463 (2004).
Ehrlich. DNA methylation in cancer: too much, but also too little. Oncogene 21(35):5400-5413 (2002).
Fackler et al. Quantitative multiplex methylation-specific PCR analysis doubles detection of tumor cells in breast ductal fluid. Clin. Cancer Res. 12(11 Pt 1):3306-3310 (2006).
Fackler et al. Quantitative multiplex methylation-specific PCR assay for the detection of promoter hypermethylation in multiple genes in breast cancer. Cancer Res. 64(13):4442-4452 (2004).
Feinberg et al. The history of cancer epigenetics. Nat Rev Cancer 4(2):143-153 (2004).
Friedman. Regularized Discriminant Analysis. Journal of the American Statistical Association 84:165-175 (1989).
Frommer et al. A genomic sequencing protocol that yields a positive display of 5-methylcytosine residues in individual DNA strands. PNAS USA 89:1827-1831 (1992).
Gebhard et al. Genome-wide profiling of CpG methylation identifies novel targets of aberrant hypermethylation in myeloid leukemia. Cancer Res. 66:6118-6128 (2006).
Gebhard et al. Rapid and sensitive detection of CpG-methylation using methyl-binding (MB)-PCR. Nucleic Acids Res. 34:e82 (2006).
Gibson et al. A novel method for real time quantitative RT-PCR. Genome Research 6:995-1001 (1996).
Gonzalgo et al. Rapid quantitation of methylation differences at specific sites using methylation-sensitive single nucleotide primer extension (Ms-SNuPE). Nucleic Acids Res. 25:2529-2531 (1997).
Grant et al. Molecular and genetic pathways in gliomas: the future of personalized therapeutics. CNS Oncology 3(2):123-136 (2014).
Greco et al. Cancer of unknown primary site. Cancer: Principles and Practice of Oncology. Ed 9. Chapter 137. Lippincott Williams & Wilkins. (2011).
Greco et al. Molecular profiling diagnosis in unknown primary cancer: accuracy and ability to complement standard pathology. J Natl Cancer Inst 105(11):782-790 (2013).
Han et al. The Pan-Cancer analysis of pseudogene expression reveals biologically and clinically relevant tumour subtypes. Nat Commun 5:3963 (2014).
Harris et al. Single-molecule DNA sequencing of a viral genome. Science 320:106-109 (2008).
Hearst et al. Support vector machines. Intelligent Systems and their Applications. IEEE 13(4):18-28 (1998).
Herman et al. Gene silencing in cancer in association with promoter hypermethylation. N Engl J Med 349(21):2042-2054 (2003).
Herman et al. Methylation-specific PCR: a novel PCR assay for methylation status of CpG islands. PNAS USA 93:9821-9826 (1996).
Heyn et al. DNA methylation profiling in the clinic: applications and challenges. Nature Reviews Genetics 13(10):679-692 (2012).
Horak et al. ChIP-chip: a genomic approach for identifying transcription factor binding sites. Methods Enzymol 350:469-483 (2002).
Hudson. A new statistic for detecting genetic differentiation. Genetics 155(4):2011-2014 (2000).
Itzkowitz et al. Improved fecal DNA test for colorectal cancer screening. Clin Gastroenterol. Hepatol. 5(1):111-117 (2007).
Jaenisch et al. Epigenetic regulation of gene expression: how the genome integrates intrinsic and environmental signals. Nat Genet 33 Suppl:245-254 (2003).
Kandoth et al. Mutational landscape and significance across 12 major cancer types. Nature 502(7471):333-339 (2013).
Koboldt et al. VarScan 2: somatic mutation and copy number alteration discovery in cancer by exome sequencing. Genome Res 22(3):568-576 (2012).
Koga et al. Genome-wide screen of promoter methylation identifies novel markers in melanoma. Genome Res. 19:1462-1470 (2009).
Kulis et al. DNA methylation and cancer. Adv Genet 70:27-56 (2010).
Langmead et al. Fast gapped-read alignment with Bowtie 2. Nature Methods 9:357-359 (2012).

(56) References Cited

OTHER PUBLICATIONS

Li et al. Multiplex padlock targeted sequencing reveals human hypermutable CpG variations. Genome Res 19(9):1606-1615 (2009).
Lieb. Genome-wide mapping of protein-DNA interactions by chromatin immunoprecipitation and DNA microarray hybridization. Methods Mol Biol 224:99-109 (2003).
Liefers et al. Micrometastases and survival in stage II colorectal cancer. N Engl J Med 339(4):223-228 (1998).
Margulies et al. Genome sequencing in microfabricated high-density picolitre reactors. Nature 437:376-380 (2005).
Mazor et al. DNA Methylation and Somatic Mutations Converge on the Cell Cycle and Define Similar Evolutionary Histories in Brain Tumors. Cancer Cell 28(3):307-317 (2015).
McClelland et al. Effect of site-specific modification on restriction endonucleases and DNA modification methyltransferases. Nucleic Acids Res.22(17):3640-3659 (1994).
Morris et al. Who to treat with adjuvant therapy in Dukes B/stage II colorectal cancer? The need for high quality pathology. Gut 56(10):1419-1425 (2007).
Murphy et al. Patterns of Colorectal Cancer Care in the United States: 1990-2010. J Natl Cancer Inst 107(10):11 pgs. (2015).
Nakano et al. Single-molecule PCR using water-in-oil emulsion. J. Biotech. 102:117-124 (2003).
Nolte. Branched DNA signal amplification for direct quantitation of nucleic acid sequences in clinical specimens. Adv. Clin. Chem. 33:201-235 (1998).
O'Geen et al. Comparison of sample preparation methods for ChIP-chip assays. BioTechniques 41(5):577-580 (2006).
Ogino et al. Predictive and prognostic analysis of PIK3CA mutation in stage III colon cancer intergroup trial. J Natl Cancer Inst 105(23):1789-1798 (2013).
O'Shea et al. Cytokine signaling in 2002: new surprises in the Jak/Stat pathway. Cell 109(2):S121-S131 (2002).
Olek et al. The pre-implantation ontogeny of the H19 methylation imprint Nat. Genet. 17(3):275-276 (1997).
Paez et al. EGFR mutations in lung cancer: correlation with clinical response to gefitinib therapy. Science 304(5676):1497-1500 (2004).
Pelizzola et al. MEDME: an experimental and analytical methodology for the estimation of DNA methylation levels based on microarray derived MeDIP-enrichment. Genome Res. 18:1652-1659 (2008).
Pentheroudakis et al. Novel microRNA-based assay demonstrates 92% agreement with diagnosis based on clinicopathologic and management data in a cohort of patients with carcinoma of unknown primary. Mol Cancer 12:57 (2013).
Porreca et al. Multiplex amplification of large sets of human exons. Nature Methods 4(11):931-936 (2007).
Raab et al. Quality in cancer diagnosis. CA Cancer J Clin 60(3):139-165 (2010).
Radmacher et al. A paradigm for class prediction using gene expression profiles. Journal of Computational Biology 9:505-511 (2002).
Ramaswamy et al. Multiclass cancer diagnosis using tumor gene expression signatures. PNAS USA 98:15149-15154 (2001).
Rauch et al. High-resolution mapping of DNA hypermethylation and hypomethylation in lung cancer. PNAS USA 105:252-257 (2008).
Rein et al. Identifying 5-methylcytosine and related modifications in DNA genomes. Nucleic Acids Res. 26(10):2255-2264 (1998).
Ross et al. Comprehensive Genomic Profiling of Carcinoma of Unknown Primary Site: New Routes to Targeted Therapies. JAMA Oncol 1(1):40-49 (2015).
Ruczinski et al. Logic Regression. Journal of Computational and Graphical Statistics 12:475-5111 (2003).
Sadri et al. Rapid analysis of DNA methylation using new restriction enzyme sites created by bisulfite modification. Nucleic Acids Res. 24:5058-5059 (1996).
Salazar et al. Gene expression signature to improve prognosis prediction of stage II and III colorectal cancer. J Clin Oncol 29(1):17-24 (2011).
Schmoll et al. Capecitabine Plus Oxaliplatin Compared With Fluorouracil/Folinic Acid as Adjuvant Therapy for Stage III Colon Cancer: Final Results of the NO16968 Randomized Controlled Phase III Trial. J Clin Oncol 33(32):3733-3740 (2015).
Shevade et al. A simple and efficient algorithm for gene selection using sparse logistic regression. Bioinformatics 19(17):2246-2253 (2003).
Shiraishi et al. Isolation of DNA fragments associated with methylated CpG islands in human adenocarcinomas of the lung using a methylated DNA binding column and denaturing gradient gel electrophoresis. PNAS USA 96(6):2913-2918 (1999).
Siegel et al. Cancer statistics, 2015. CA: A cancer journal for clinicians 65:5-29 (2015).
Simon et al. Pitfalls in the use of DNA microarray data for diagnostic and prognostic classification. Journal of the National Cancer Institute 95:14-18 (2003).
Smith et al. Cancer screening in the United States, 2015: a review of current American cancer society guidelines and current issues in cancer screening. CA Cancer J Clin 65(1):30-54 (2015).
Soni et al. Progress toward ultrafast DNA sequencing using solid-state nanopores. Clin. Chem. 53:1996-2001 (2007).
Sorlie et al. Gene expression patterns of breast carcinomas distinguish tumor subclasses with clinical implications. PNAS 98:10869-10874 (2001).
Sultan et al. Stat5 promotes homotypic adhesion and inhibits invasive characteristics of human breast cancer cells. Oncogene 24(5):746-760 (2005).
Thomas et al. The role of JAK/STAT signalling in the pathogenesis, prognosis and treatment of solid tumours. British J Cancer 113(3):365-371 (2015).
Tost et al. DNA methylation analysis by pyrosequencing. Nature Protocols 2:2265-2275 (2007).
Toyota et al. Identification of differentially methylated sequences in colorectal cancer by methylated CpG island amplification. Cancer Res. 59:2307-2312 (1999).
Tran et al. Prolactin inhibits BCL6 expression in breast cancer through a Stat5a-dependent mechanism. Cancer Res 70(4):1711-1721 (2010).
Ushijima et al. Methylation-Sensitive Representational Difference Analysis (MS-RDA). Methods Mol Biol507:117-130 (2009).
Vaissiere et al. Epigenetic interplay between histone modifications and DNA methylation in gene silencing. Mutat Res 659(1-2):40-48 (2008).
Varadhachary. New strategies for carcinoma of unknown primary: the role of tissue-of-origin molecular profiling. Clin Cancer Res 19(15):4027-4033 (2013).
Vedeld et al. The novel colorectal cancer biomarkers CDO1, ZSCAN18 and ZNF331 are frequently methylated across gastrointestinal cancers. Int J Cance 136:844-853 (2015).
Wang et al. Identification and characterization of essential genes in the human genome. Science 350(6264):1096-1101 (2015).
Weber et al. Chromosome-wide and promoter-specific analyses identify sites of differential DNA methylation in normal and transformed human cells. Nat. Genet. 37:853-862 (2005).
Weinstein et al. The Cancer Genome Atlas Pan-Cancer analysis project. Nat Genet 45(10):1113-1120 (2013).
Wojdacz et al. Methylation-sensitive high resolution melting (MS-HRM): a new approach for sensitive and high-throughput assessment of methylation. Nucleic Acids Res. 35(6):e41 (2007).
Wojdacz et al. Methylation-sensitive high-resolution melting. Nature Protocols 3(12):1903-1908 (2008).
Xiong et al COBRA: a sensitive and quantitative DNA methylation assay. Nucleic Acids Res. 25:2532-2534 (1997).
Yan et al. IDH1 and IDH2 mutations in gliomas. N Engl J Med 360(8):765-773 (2009).
Yao et al. Inferring regulatory element landscapes and transcription factor networks from cancer methylomes. Genome Biol 16:105 (2015).
PCT/US2016/013716 International Search Report and Written Opinion dated May 12, 2016.

(56) References Cited

OTHER PUBLICATIONS

PCT/US2016/013716 International Preliminary Report on Patentability dated Jul. 27, 2017.

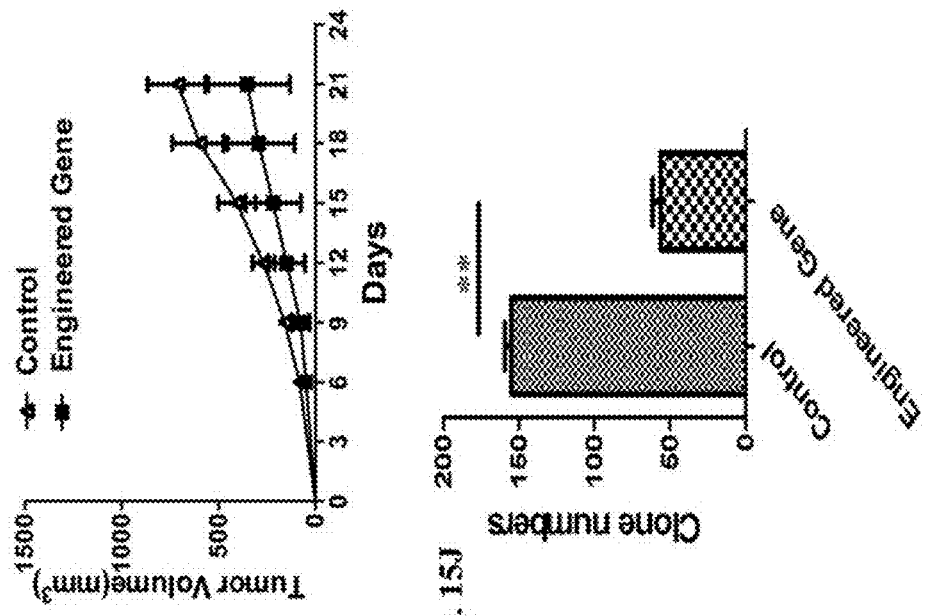
Fig. 15H
Fig. 15J
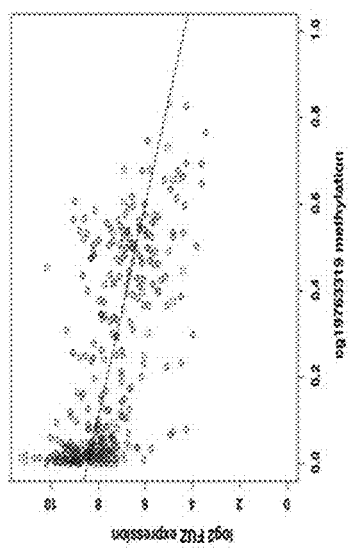
Fig. 15F
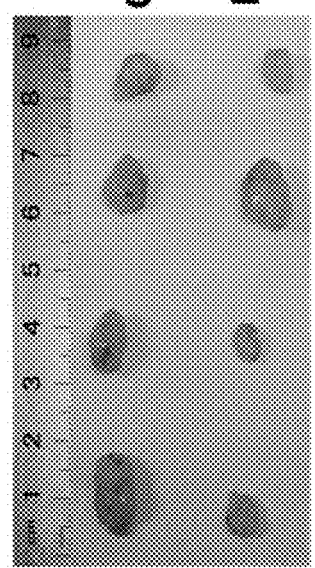
Fig. 15G
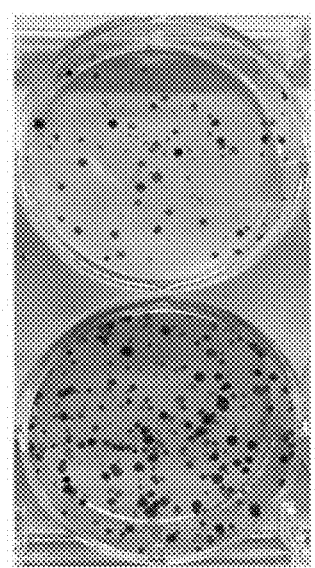
Fig. 15I

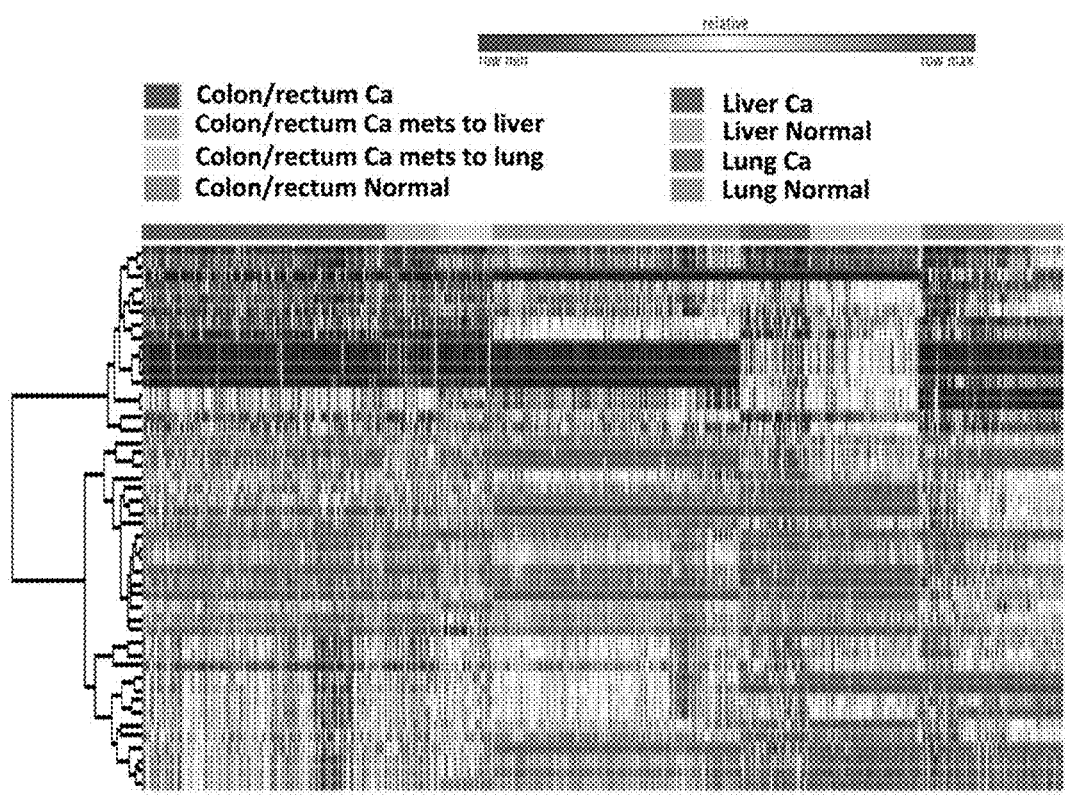

Fig. 20E

| GENE | logrank test P | logrank test Q |
|---|---|---|
| SKIV2L2 | 2.24E-06 | 0.0452 |
| TRIM25 | 1.10E-05 | 0.111 |
| PNP | 0.0003264 | 0.382 |
| BTF3L4 | 0.0017997 | 0.574 |
| TMSB15B | 0.0022783 | 0.574 |
| VPS52 | 0.002343 | 0.574 |
| CD3D | 0.0027571 | 0.574 |
| LATS1 | 0.0037648 | 0.574 |
| OR10G4 | 0.0039144 | 0.574 |
| MTTP | 0.0048273 | 0.574 |
| LRMP | 0.0051523 | 0.576 |
| OR7C1 | 0.0058688 | 0.576 |
| HIST1H3B | 0.0067924 | 0.583 |
| BFSP1 | 0.0074242 | 0.591 |
| CCDC3 | 0.0085954 | 0.604 |
| TRIM24 | 0.0093138 | 0.616 |
| ZNF658 | 0.01464 | 0.652 |
| WDR75 | 0.014715 | 0.652 |
| MRPS5 | 0.016738 | 0.659 |
| OSBPL11 | 0.01807 | 0.666 |
| CHM | 0.019045 | 0.666 |
| GANAB | 0.023875 | 0.676 |
| IL8 | 0.025263 | 0.676 |
| CSF3R | 0.025297 | 0.676 |
| MBD6 | 0.025702 | 0.676 |
| P8HD1 | 0.027323 | 0.682 |
| CCR8 | 0.028097 | 0.686 |
| BRSK1 | 0.029512 | 0.686 |
| FOXF2 | 0.030782 | 0.686 |
| SMC2 | 0.033294 | 0.686 |
| GPR160 | 0.033618 | 0.686 |
| MKL2 | 0.034518 | 0.686 |
| AKT1 | 0.038775 | 0.699 |
| CNKSR3 | 0.039065 | 0.701 |
| RAB38 | 0.041792 | 0.707 |
| GCNT4 | 0.047613 | 0.72 |
| C6ORF89 | 0.049773 | 0.72 |

Fig. 21

| Characteristic | Training Cohort ||||| Validation Cohort 1 ||||| Validation Cohort 2 |||
|---|---|---|---|---|---|---|---|---|---|---|---|---|---|
| | Colon/rectum Ca | Lung Ca | Liver Ca | Colon/rectum Ca | Lung Ca | Liver Ca | Colon/rectum Ca | Colon/rectum Ca mets to liver | Colon/rectum Ca mets to lung | Lung Ca | Liver Ca |
| Total (n) | 390 | 311 | 238 | 124 | 199 | 70 | 161 | 33 | 34 | 47 | 48 |
| Gender | | | | | | | | | | | |
| Female-no.(%) | 179(45.9) | 163(52.4) | 83(34.9) | 55(43.5) | 108(54.3) | 24(34.3) | 52(32.3) | 12(36.4) | 9(26.5) | 14(29.8) | 9(18.8) |
| Male-no.(%) | 211(54.1) | 148(47.6) | 155(65.1) | 70(56.5) | 91(45.7) | 46(65.7) | 71(44.1) | 20(60.6) | 25(73.5) | 31(65.9) | 39(81.2) |
| NA | 0 | 0 | 0 | 0 | 0 | 0 | 38(23.6) | 1(3.0) | 0 | 2(4.3) | 0 |
| Age (years) | | | | | | | | | | | |
| Mean | 64 | 65 | 60 | 65 | 65 | 58 | 57 | 56 | 59 | 57 | 50 |
| Range | 31-90 | 40-87 | 17-90 | 31-90 | 33-86 | 17-81 | 27-79 | 30-77 | 32-81 | 37-83 | 21-60 |
| Race | | | | | | | | | | | |
| White-no.(%) | 283(72.6) | 248(79.7) | 152(63.9) | 76(61.3) | 152(76.4) | 39(55.7) | 0 | 0 | 0 | 0 | 0 |
| Asian-no.(%) | 12(3.1) | 3(1.0) | 61(25.6) | 1(0.8) | 0 | 26(37.2) | 161(100) | 33(100) | 34(100) | 47(100) | 48(100) |
| Other | 95(24.3) | 60(19.3) | 25(10.5) | 47(37.9) | 47(23.6) | 5(7.1) | 0 | 0 | 0 | 0 | 0 |

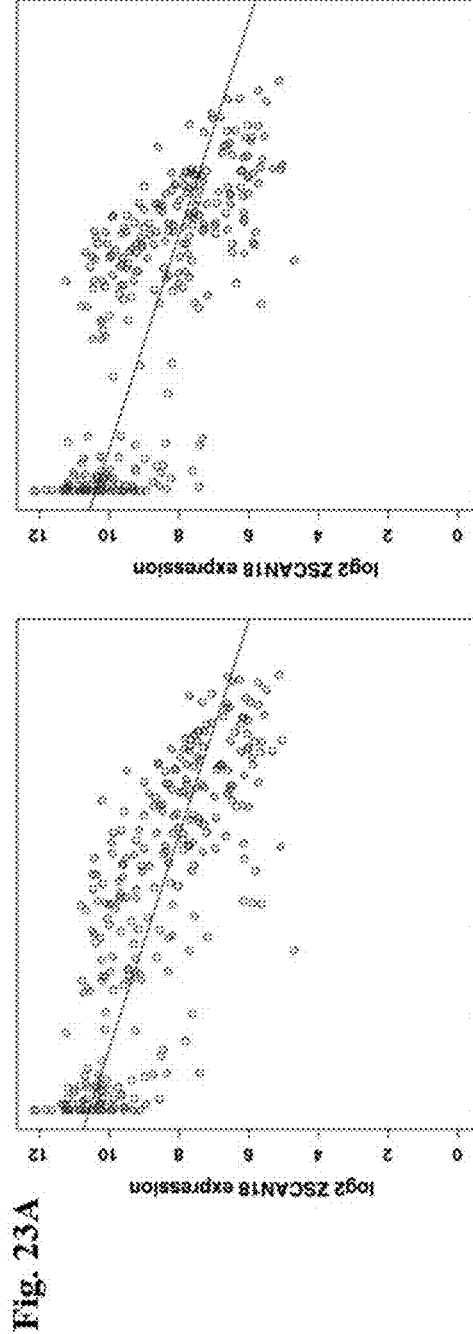
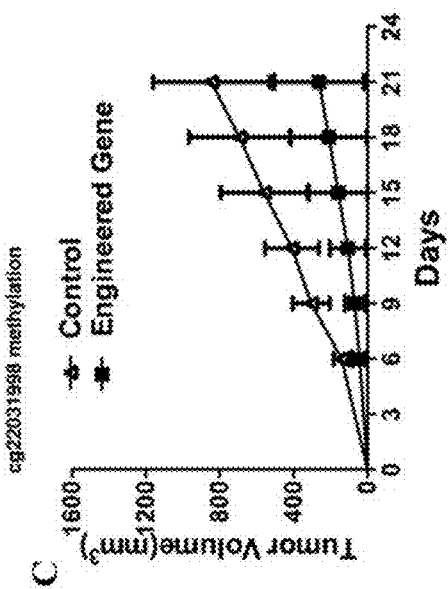
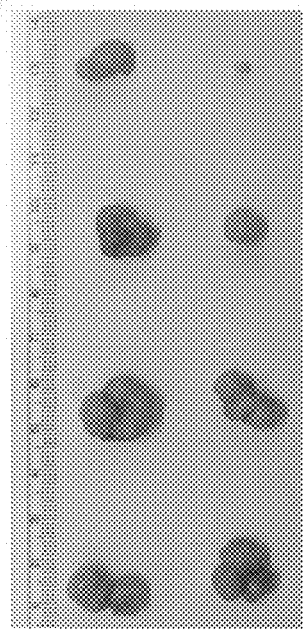
Fig. 23A
Fig. 23B
Fig. 23C

METHOD AND SYSTEM FOR DETERMINING CANCER STATUS

CROSS-REFERENCE

This application claims the benefit of U.S. Provisional Application No. 62/104,785, filed Jan. 18, 2015, which is incorporated herein by reference.

SEQUENCE LISTING

The instant application contains a Sequence Listing which has been submitted in ASCII format via EFS-Web and is hereby incorporated by reference in its entirety. Said ASCII copy, created on Dec. 31, 2015 is named 49697-701.201_SL.txt and is 859,456 bytes in size.

INCORPORATION BY REFERENCE OF TABLE SUBMITTED AS TEXT FILE VIA EFS-WEB

The instant application contains Tables 56-59, which have been submitted as a computer readable text file in ASCII format via EFS-Web and are hereby incorporated in their entirety by reference herein. The text files, created date of Dec. 29, 2015, are named 49697-701-201_Table56.txt, 49697-701-201_Table57.txt, 49697-701-201_Table58.txt, and 49697-701-201_Table59.txt, and are 132 kilobytes, 149 kilobytes, 17 kilobytes, and 17 kilobytes, respectively, in size.

LENGTHY TABLES

The patent contains a lengthy table section. A copy of the table is available in electronic form from the USPTO web site (http://seqdata.uspto.gov/?pageRequest=docDetail&DocID=US09984201B2). An electronic copy of the table will also be available from the USPTO upon request and payment of the fee set forth in 37 CFR 1.19(b)(3).

BACKGROUND OF THE INVENTION

Cancer is a leading cause of deaths worldwide, with annual cases expected to increase from 14 million in 2012 to 22 million during the next two decades (WHO). Diagnostic procedures, in some cases, begin only after a patient is already present with symptoms, leading to costly, invasive, and time-consuming procedures. In addition, inaccessible areas sometimes prevent an accurate diagnosis. Further, high cancer morbidities and mortalities are associated with late diagnosis.

SUMMARY OF THE INVENTION

Disclosed herein, in certain embodiments, are methods, systems, platform, non-transitory computer-readable medium, services, and kits for determining a cancer type in an individual. In some embodiments, also described herein include methods, systems, platform, non-transitory computer-readable medium, services, and kits for early detection of cancer. In additional embodiments, described herein include methods, systems, platform, non-transitory computer-readable medium, services, and kits for non-invasive detection of cancer. In still additional embodiments, described herein include methods, systems, platform, non-transitory computer-readable medium, services, and kits for distinguishing different cancer stages. In other embodiments, described herein include methods, systems, platform, non-transitory computer-readable medium, services, and kits for determining the prognosis of a cancer in an individual in need thereof, prediction of a treatment response, and treatment response monitoring. In further embodiments, described herein include methods, systems, platform, non-transitory computer-readable medium, services, and kits for generating a CpG methylation profile database, and probes used in generating CpG methylation data.

Disclosed herein, in certain embodiments, is a computing platform for utilizing CpG cancer methylation data for generation of a cancer CpG methylation profile database, comprising:
 (a) a first computing device comprising a processor, a memory module, an operating system, and a computer program including instructions executable by the processor to create a data acquisition application for generating CpG methylation data from a set of biological samples, the data acquisition application comprising:
  (1) a sequencing module configured to operate a sequencing device to generate CpG methylation data from a set of biological samples, wherein the set comprises a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different; and
  (2) a data receiving module configured to receive:
   (i) a first pair of CpG methylation datasets generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
   (ii) a second pair of CpG methylation datasets generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different; and
   (iii) a third pair of CpG methylation datasets generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different; and (b) a second computing device comprising a processor, a memory module, an operating system, and a computer program including instructions executable by the processor to create a data analysis application for generating a cancer CpG methylation profile database, the data analysis application comprising a data analysis module configured to:
  (1) generate a pair-wise methylation difference dataset from the first, second, and third pair of datasets; and
  (2) analyze the pair-wise methylation difference dataset with a control dataset by a machine learning method to generate the cancer CpG methylation profile database, wherein
    (i) the machine learning method comprises: identifying a plurality of markers and a plurality of weights based on a top score, and classifying the samples based on the plurality of markers and the plurality of weights; and
    (ii) the cancer CpG methylation profile database comprises a set of CpG methylation profiles and each CpG methylation profile represents a cancer type.

In some embodiments, the generating the pair-wise methylation difference dataset comprises: (a) calculating a difference between the first dataset and the second dataset within the first pair of datasets; (b) calculating a difference between the third dataset and the fourth dataset within the second pair of datasets; and (c) calculating a difference between the fifth dataset and the sixth dataset within the third pair of datasets. In some embodiments, the generating the pair-wise methylation difference dataset is further based on the calculated difference of the first pair of datasets, the calculated difference of the second pair of datasets, and the calculated difference of the third pair of dataset.

In some embodiments, the machine learning method comprises a semi-supervised learning method or an unsupervised learning method. In some embodiments, the machine learning method utilizes an algorithm selected from one or more of the following: a principal component analysis, a logistic regression analysis, a nearest neighbor analysis, a support vector machine, and a neural network model.

In some embodiments, the CpG methylation data is generated from an extracted genomic DNA treated with a deaminating agent. In some embodiments, the data analysis module is further configured to analyze the extracted genomic DNA by a next generation sequencing method to generate the CpG methylation data. In some embodiments, the next generation sequencing method is a digital PCR sequencing method.

In some embodiments, the methylation profile comprises at least 10, 20, 30, 40, 50, 100, 200, or more of biomarkers selected from the group consisting of Tables 8-41 and 56-59. In some embodiments, the methylation profile comprises about 10, 20, 30, 40, 50, 60, 70, 80, 90, or 100 biomarkers selected from the group consisting of Tables 56-59.

In some embodiments, the cancer type is a solid cancer type or a hematologic malignant cancer type. In some embodiments, the cancer type is a metastatic cancer type or a relapsed or refractory cancer type. In some embodiments, the cancer type comprises acute myeloid leukemia (LAML or AML), acute lymphoblastic leukemia (ALL), adrenocortical carcinoma (ACC), bladder urothelial cancer (BLCA), brain stem glioma, brain lower grade glioma (LGG), brain tumor, breast cancer (BRCA), bronchial tumors, Burkitt lymphoma, cancer of unknown primary site, carcinoid tumor, carcinoma of unknown primary site, central nervous system atypical teratoid/rhabdoid tumor, central nervous system embryonal tumors, cervical squamous cell carcinoma, endocervical adenocarcinoma (CESC) cancer, childhood cancers, cholangiocarcinoma (CHOL), chordoma, chronic lymphocytic leukemia, chronic myelogenous leukemia, chronic myeloproliferative disorders, colon (adenocarcinoma) cancer (COAD), colorectal cancer, craniopharyngioma, cutaneous T-cell lymphoma, endocrine pancreas islet cell tumors, endometrial cancer, ependymoblastoma, ependymoma, esophageal cancer (ESCA), esthesioneuroblastoma, Ewing sarcoma, extracranial germ cell tumor, extragonadal germ cell tumor, extrahepatic bile duct cancer, gallbladder cancer, gastric (stomach) cancer, gastrointestinal carcinoid tumor, gastrointestinal stromal cell tumor, gastrointestinal stromal tumor (GIST), gestational trophoblastic tumor, glioblstoma multiforme glioma GBM, hairy cell leukemia, head and neck cancer (HNSD), heart cancer, Hodgkin lymphoma, hypopharyngeal cancer, intraocular melanoma, islet cell tumors, Kaposi sarcoma, kidney cancer, Langerhans cell histiocytosis, laryngeal cancer, lip cancer, liver cancer, Lymphoid Neoplasm Diffuse Large B-cell Lymphoma [DLBCL), malignant fibrous histiocytoma bone cancer, medulloblastoma, medullo epithelioma, melanoma, Merkel cell carcinoma, Merkel cell skin carcinoma, mesothelioma (MESO), metastatic squamous neck cancer with occult primary, mouth cancer, multiple endocrine neoplasia syndromes, multiple myeloma, multiple myeloma/plasma cell neoplasm, mycosis fungoides, myelodysplastic syndromes, myeloproliferative neoplasms, nasal cavity cancer, nasopharyngeal cancer, neuroblastoma, Non-Hodgkin lymphoma, nonmelanoma skin cancer, non-small cell lung cancer, oral cancer, oral cavity cancer, oropharyngeal cancer, osteosarcoma, other brain and spinal cord tumors, ovarian cancer, ovarian epithelial cancer, ovarian germ cell tumor, ovarian low malignant potential tumor, pancreatic cancer, papillomatosis, paranasal sinus cancer, parathyroid cancer, pelvic cancer, penile cancer, pharyngeal cancer, pheochromocytoma and paraganglioma (PCPG), pineal parenchymal tumors of intermediate differentiation, pineoblastoma, pituitary tumor, plasma cell neoplasm/multiple myeloma, pleuropulmonary blastoma, primary central nervous system (CNS) lymphoma, primary hepatocellular liver cancer, prostate cancer such as prostate adenocarcinoma (PRAD), rectal cancer, renal cancer, renal cell (kidney) cancer, renal cell cancer, respiratory tract cancer, retinoblastoma, rhabdomyosarcoma, salivary gland cancer, sarcoma (SARC), Sezary syndrome, skin cutaneous melanoma (SKCM), small cell lung cancer, small intestine cancer, soft tissue sarcoma, squamous cell carcinoma, squamous neck cancer, stomach (gastric) cancer, supratentorial primitive neuroectodermal tumors, T-cell lymphoma, testicular cancer testicular germ cell tumors (TGCT), throat cancer, thymic carcinoma, thymoma (THYM), thyroid cancer (THCA), transitional cell cancer, transitional cell cancer of the renal pelvis and ureter, trophoblastic tumor, ureter cancer, urethral cancer, uterine cancer, uterine cancer, uveal melanoma (UVM), vaginal cancer, vulvar cancer, Waldenstrom macroglobulinemia, or Wilm's tumor. In some embodiments, the cancer type comprises acute lymphoblastic leukemia, acute myeloid leukemia, bladder cancer, breast cancer, brain cancer, cervical cancer, cholangiocarcinoma, colon cancer, colorectal cancer, endometrial cancer, esophageal cancer, gastrointestinal cancer, glioma, glioblastoma, head and neck cancer, kidney cancer, liver cancer, lung cancer, lymphoid neoplasia, melanoma, a myeloid neoplasia, ovarian cancer, pancreatic cancer, pheochromocytoma and paraganglioma, prostate cancer, rectal cancer, squamous cell carcinoma, testicular cancer, stomach cancer, or thyroid cancer.

In some embodiments, the control dataset comprises a set of methylation profiles, wherein each said methylation profile is generated from a biological sample obtained from a known cancer type.

In some embodiments, the biological samples comprise a cell-free biological sample. In some embodiments, the biological samples comprise a circulating tumor DNA sample. In some embodiments, the biological samples comprise a biopsy sample. In some embodiments, the biological samples comprise a tissue sample.

In some embodiments, described herein is a computing system comprising a processor, a memory module, an operating system configured to execute machine readable instructions, and a computer program including instructions executable by the processor to create an analysis application for generating a cancer CpG methylation profile database, the analysis application comprising:
 (a) a data receiving module configured to receive:
  (1) a first pair of CpG methylation datasets generated from a first cancerous biological sample and a first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
  (2) second pair of CpG methylation datasets generated from a second normal biological sample and a third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different; and
  (3) a third pair of CpG methylation datasets generated from a second cancerous biological sample and a third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different; and
 (b) a data analysis module configured to:
  (1) generate a pair-wise methylation difference dataset from the first, second, and third pair of datasets; and
  (2) analyze the pair-wise methylation difference dataset with a control dataset by a machine learning method to generate the cancer CpG methylation profile database, wherein
   (i) the machine learning method comprises: identifying a plurality of markers and a plurality of weights based on a top score, and classifying the samples based on the plurality of markers and the plurality of weights; and
   (ii) the cancer CpG methylation profile database comprises a set of CpG methylation profiles and each CpG methylation profile represents a cancer type.

Disclosed herein, in certain embodiments, is a computer-implemented method for generating a cancer CpG methylation profile database, comprising:
 a. generating CpG methylation data from a set of biological samples by a sequencing method, wherein the set comprises a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different;
 b. obtaining a first pair of CpG methylation datasets, with a first processor, generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
 c. obtaining a second pair of CpG methylation datasets, with the first computing device, generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different;
 d. obtaining a third pair of CpG methylation datasets, with the first computing device, generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different;
 e. generating a pair-wise methylation difference dataset, with a second processor, from the first, second, and third pair of datasets; and
 f. analyzing the pair-wise methylation difference dataset with a control dataset by a machine learning method to generate the cancer CpG methylation profile database, wherein
  (1) the machine learning method comprises: identifying a plurality of markers and a plurality of weights based on a top score, and classifying the samples based on the plurality of markers and the plurality of weights; and
  (2) the cancer CpG methylation profile database comprises a set of CpG methylation profiles and each CpG methylation profile represents a cancer type.

In some embodiments, step e) further comprises (a) calculating a difference between the first dataset and the second dataset within the first pair of datasets; (b) calculating a difference between the third dataset and the fourth dataset within the second pair of datasets; and (c) calculating a difference between the fifth dataset and the sixth dataset within the third pair of datasets. In some embodiments, step e) further comprises generating the pair-wise methylation difference dataset, with the second processor, from the calculated difference of the first pair of datasets, the calculated difference of the second pair of datasets, and the calculated difference of the third pair of dataset.

In some embodiments, the machine learning method comprises a semi-supervised learning method or an unsupervised learning method. In some embodiments, the machine learning method utilizes an algorithm selected from one or more of the following: a principal component analysis, a logistic regression analysis, a nearest neighbor analysis, a support vector machine, and a neural network model.

In some embodiments, the CpG methylation data is generated from an extracted genomic DNA treated with a deaminating agent.

In some embodiments, the methylation profile comprises at least 10, 20, 30, 40, 50, 100, 200, or more of biomarkers selected from the group consisting of Tables 8-41 or Tables 56-59.

In some embodiments, the cancer type is a solid cancer type or a hematologic malignant cancer type. In some embodiments, the cancer type is a relapsed or refractory cancer type. In some embodiments, the cancer type comprises acute myeloid leukemia (LAML or AML), acute lymphoblastic leukemia (ALL), adrenocortical carcinoma (ACC), bladder urothelial cancer (BLCA), brain stem glioma, brain lower grade glioma (LGG), brain tumor, breast cancer (BRCA), bronchial tumors, Burkitt lymphoma, cancer of unknown primary site, carcinoid tumor, carcinoma of unknown primary site, central nervous system atypical teratoid/rhabdoid tumor, central nervous system embryonal tumors, cervical squamous cell carcinoma, endocervical adenocarcinoma (CESC) cancer, childhood cancers, cholangiocarcinoma (CHOL), chordoma, chronic lymphocytic leukemia, chronic myelogenous leukemia, chronic myeloproliferative disorders, colon (adenocarcinoma) cancer (COAD), colorectal cancer, craniopharyngioma, cutaneous T-cell lymphoma, endocrine pancreas islet cell tumors, endometrial cancer, ependymoblastoma, ependymoma, esophageal cancer (ESCA), esthesioneuroblastoma, Ewing sarcoma, extracranial germ cell tumor, extragonadal germ cell tumor, extrahepatic bile duct cancer, gallbladder cancer, gastric (stomach) cancer, gastrointestinal carcinoid tumor, gastrointestinal stromal cell tumor, gastrointestinal stromal tumor (GIST), gestational trophoblastic tumor, glioblstoma multiforme glioma GBM), hairy cell leukemia, head and neck cancer (HNSD), heart cancer, Hodgkin lymphoma, hypopharyngeal cancer, intraocular melanoma, islet cell tumors, Kaposi sarcoma, kidney cancer, Langerhans cell histiocytosis, laryngeal cancer, lip cancer, liver cancer, Lymphoid Neoplasm Diffuse Large B-cell Lymphoma [DLBCL], malignant fibrous histiocytoma bone cancer, medulloblastoma, medullo epithelioma, melanoma, Merkel cell carcinoma, Merkel cell skin carcinoma, mesothelioma (MESO), metastatic squamous neck cancer with occult primary, mouth cancer, multiple endocrine neoplasia syndromes, multiple myeloma, multiple myeloma/plasma cell neoplasm, mycosis fungoides, myelodysplastic syndromes, myeloproliferative neoplasms, nasal cavity cancer, nasopharyngeal cancer, neuroblastoma, Non-Hodgkin lymphoma, nonmelanoma skin cancer, non-small cell lung cancer, oral cancer, oral cavity cancer, oropharyngeal cancer, osteosarcoma, other brain and spinal cord tumors, ovarian cancer, ovarian epithelial cancer, ovarian germ cell tumor, ovarian low malignant potential tumor, pancreatic cancer, papillomatosis, paranasal sinus cancer, parathyroid cancer, pelvic cancer, penile cancer, pharyngeal cancer, pheochromocytoma and paraganglioma (PCPG), pineal parenchymal tumors of intermediate differentiation, pineoblastoma, pituitary tumor, plasma cell neoplasm/multiple myeloma, pleuropulmonary blastoma, primary central nervous system (CNS) lymphoma, primary hepatocellular liver cancer, prostate cancer such as prostate adenocarcinoma (PRAD), rectal cancer, renal cancer, renal cell (kidney) cancer, renal cell cancer, respiratory tract cancer, retinoblastoma, rhabdomyosarcoma, salivary gland cancer, sarcoma (SARC), Sezary syndrome, skin cutaneous melanoma (SKCM), small cell lung cancer, small intestine cancer, soft tissue sarcoma, squamous cell carcinoma, squamous neck cancer, stomach (gastric) cancer, supratentorial primitive neuroectodermal tumors, T-cell lymphoma, testicular cancer testicular germ cell tumors (TGCT), throat cancer, thymic carcinoma, thymoma (THYM), thyroid cancer (THCA), transitional cell cancer, transitional cell cancer of the renal pelvis and ureter, trophoblastic tumor, ureter cancer, urethral cancer, uterine cancer, uterine cancer, uveal melanoma (UVM), vaginal cancer, vulvar cancer, Waldenstrom macroglobulinemia, or Wilm's tumor. In some embodiments, the cancer type comprises acute lymphoblastic leukemia, acute myeloid leukemia, bladder cancer, breast cancer, brain cancer, cervical cancer, cholangiocarcinoma, colon cancer, colorectal cancer, endometrial cancer, esophageal cancer, gastrointestinal cancer, glioma, glioblastoma, head and neck cancer, kidney cancer, liver cancer, lung cancer, lymphoid neoplasia, melanoma, a myeloid neoplasia, ovarian cancer, pancreatic cancer, pheochromocytoma and paraganglioma, prostate cancer, rectal cancer, squamous cell carcinoma, testicular cancer, stomach cancer, or thyroid cancer.

In some embodiments, the control dataset comprises a set of methylation profiles, wherein each said methylation profile is generated from a biological sample obtained from a known cancer type.

In some embodiments, the biological samples comprise a cell-free biological sample. In some embodiments, the biological samples comprise a circulating tumor DNA sample. In some embodiments, the biological samples comprise a biopsy sample. In some embodiments, the biological samples comprise a tissue sample.

In some embodiments, described herein is a computer-implemented method of cancer diagnosis in an individual in need thereof, comprising:
  a. obtaining a fourth pair of CpG methylation datasets, with the first processor, generated from a fourth cancerous biological sample and a fourth normal biological sample, wherein CpG methylation data generated from the fourth cancerous biological sample form a seventh dataset within the fourth pair of datasets, CpG methylation data generated from the first normal biological sample form an eighth dataset within the fourth pair of datasets, and the fourth cancerous biological sample and the fourth normal biological sample are from the same biological sample source;
  b. obtaining a fifth pair of CpG methylation datasets, with the first processor, generated from a fifth normal biological sample and a sixth normal biological sample, wherein CpG methylation data generated from the fifth normal biological sample form a ninth dataset within the fifth pair of datasets, CpG methylation data generated from the sixth normal biological sample form a tenth dataset within the fifth pair of datasets, and the fourth, fifth, and sixth normal biological samples are different;

c. obtaining a sixth pair of CpG methylation datasets, with the first processor, generated from a fifth cancerous biological sample and a sixth cancerous biological sample, wherein CpG methylation data generated from the fifth cancerous biological sample form a eleventh dataset within the sixth pair of datasets, CpG methylation data generated from the sixth cancerous biological sample form a twelve dataset within the sixth pair of datasets, and the fourth, fifth, and sixth cancerous biological samples are different;

d. generating a second pair-wise methylation difference dataset, with the second processor, from the fourth, fifth, and sixth pair of datasets; and e. analyzing the second pair-wise methylation difference dataset with the cancer CpG methylation profile database described above, wherein a correlation between the second pair-wise methylation difference dataset and a CpG methylation profile within the cancer CpG methylation profile database determines a cancer type of the individual.

In some embodiments, the first processor is on a first computing device and the second processor is on a second computing device. In some embodiments, the method further comprises implementing a treatment regimen based on the diagnosed cancer type.

In some embodiments, described herein is a computer-implemented method of differentiating a primary tumor from a metastatic cancer in an individual in need thereof, comprising:

a. obtaining a fourth pair of CpG methylation datasets, with the first processor, generated from a fourth cancerous biological sample and a fourth normal biological sample, wherein CpG methylation data generated from the fourth cancerous biological sample form a seventh dataset within the fourth pair of datasets, CpG methylation data generated from the first normal biological sample form an eighth dataset within the fourth pair of datasets, and the fourth cancerous biological sample and the fourth normal biological sample are from the same biological sample source;

b. obtaining a fifth pair of CpG methylation datasets, with the first processor, generated from a fifth normal biological sample and a sixth normal biological sample, wherein CpG methylation data generated from the fifth normal biological sample form a ninth dataset within the fifth pair of datasets, CpG methylation data generated from the sixth normal biological sample form a tenth dataset within the fifth pair of datasets, and the fourth, fifth, and sixth normal biological samples are different;

c. obtaining a sixth pair of CpG methylation datasets, with the first processor, generated from a fifth cancerous biological sample and a sixth cancerous biological sample, wherein CpG methylation data generated from the fifth cancerous biological sample form a eleventh dataset within the sixth pair of datasets, CpG methylation data generated from the sixth cancerous biological sample form a twelve dataset within the sixth pair of datasets, and the fourth, fifth, and sixth cancerous biological samples are different;

d. generating a second pair-wise methylation difference dataset, with the second processor, from the fourth, fifth, and sixth pair of datasets; and e. analyzing the second pair-wise methylation difference dataset with the cancer CpG methylation profile database described above, wherein a correlation between the second pair-wise methylation difference dataset and a CpG methylation profile within the cancer CpG methylation profile database differentiates a primary tumor from a metastatic cancer in the individual.

In some embodiments, described herein is a computer-implemented method of monitoring the progression of cancer in an individual in need thereof, comprising:

a. obtaining a fourth pair of CpG methylation datasets, with the first processor, generated from a fourth cancerous biological sample and a fourth normal biological sample, wherein CpG methylation data generated from the fourth cancerous biological sample form a seventh dataset within the fourth pair of datasets, CpG methylation data generated from the first normal biological sample form a eighth dataset within the fourth pair of datasets, and the fourth cancerous biological sample and the fourth normal biological sample are from the same biological sample source;

b. obtaining a fifth pair of CpG methylation datasets, with the first processor, generated from a fifth normal biological sample and a sixth normal biological sample, wherein CpG methylation data generated from the fifth normal biological sample form a ninth dataset within the fifth pair of datasets, CpG methylation data generated from the sixth normal biological sample form a tenth dataset within the fifth pair of datasets, and the fourth, fifth, and sixth normal biological samples are different;

c. obtaining a sixth pair of CpG methylation datasets, with the first processor, generated from a fifth cancerous biological sample and a sixth cancerous biological sample, wherein CpG methylation data generated from the fifth cancerous biological sample form a eleventh dataset within the sixth pair of datasets, CpG methylation data generated from the sixth cancerous biological sample form a twelve dataset within the sixth pair of datasets, and the fourth, fifth, and sixth cancerous biological samples are different;

d. generating a second pair-wise methylation difference dataset, with the second processor, from the fourth, fifth, and sixth pair of datasets; and e. analyzing the second pair-wise methylation difference dataset with the cancer CpG methylation profile database described above, wherein a correlation between the second pair-wise methylation difference dataset and a CpG methylation profile within the cancer CpG methylation profile database indicates whether there is a progression of cancer in the individual.

In some embodiments, the individual has received a treatment prior to obtaining the first cancerous biological sample and the first normal biological sample.

In some embodiments, described herein is a computer-implemented method of determining a cancer progression in an individual in need thereof, comprising:

a. obtaining a fourth pair of CpG methylation datasets, with the first processor, generated from a fourth cancerous biological sample and a fourth normal biological sample, wherein CpG methylation data generated from the fourth cancerous biological sample form a seventh dataset within the fourth pair of datasets, CpG methylation data generated from the first normal biological sample form a eighth dataset within the fourth pair of datasets, and the fourth cancerous biological sample and the fourth normal biological sample are from the same biological sample source;
b. obtaining a fifth pair of CpG methylation datasets, with the first processor, generated from a fifth normal biological sample and a sixth normal biological sample, wherein CpG methylation data generated from the fifth normal biological sample form a ninth dataset within the fifth pair of datasets, CpG methylation data generated from the sixth normal biological sample form a tenth dataset within the fifth pair of datasets, and the fourth, fifth, and sixth normal biological samples are different;
c. obtaining a sixth pair of CpG methylation datasets, with the first processor, generated from a fifth cancerous biological sample and a sixth cancerous biological sample, wherein CpG methylation data generated from the fifth cancerous biological sample form a eleventh dataset within the sixth pair of datasets, CpG methylation data generated from the sixth cancerous biological sample form a twelve dataset within the sixth pair of datasets, and the fourth, fifth, and sixth cancerous biological samples are different;
d. generating a second pair-wise methylation difference dataset, with the second processor, from the fourth, fifth, and sixth pair of datasets; and
e. analyzing the second pair-wise methylation difference dataset with the cancer CpG methylation profile database described above, wherein a correlation between the second pair-wise methylation difference dataset and a CpG methylation profile within the cancer CpG methylation profile database determines the cancer prognosis in the individual.

In some embodiments, the cancer prognosis correlates to a cancer stage. In some embodiments, the cancer prognosis does not correlate to a cancer stage. In some embodiments, the cancer prognosis indicates a potential to have a treatment response in the individual.

Disclosed herein, in certain embodiments, is a probe panel comprising a plurality of probes, each probe is the probe of Formula I:

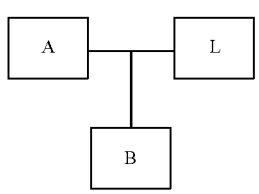

Formula I wherein:
A is a first target-binding region;
B is a second target-binding region; and
L is a linker region;
wherein A comprises at least 70%, 80%, 90%, 95%, or 99% sequence identity to at least 30 contiguous nucleotides starting at position 1 from the 5' terminus of a sequence selected from SEQ ID NOs: 1-1775; B comprises at least 70%, 80%, 90%, 95%, or 99% sequence identity to at least 12 contiguous nucleotides starting at position 1' from the 3' terminus of the same sequence selected from SEQ ID NOs: 1-1775; L is attached to A; and B is attached to either A or L.

In some embodiments, L is attached to A and B is attached to L. In some embodiments, the plurality of probes comprises at least 10, 20, 30, 50, 100, or more probes. In some embodiments, the plurality of probes is used in a solution-based next generation sequencing reaction to generate a CpG methylation data. In some embodiments, the solution-based next generation sequencing reaction is a droplet digital PCR sequencing method. In some embodiments, each probe correlates to a CpG site. In some embodiments, L is between 10 and 60, 15 and 55, 20 and 50, 25 and 45, and 30 and 40 nucleotides in length. In some embodiments, L further comprises an adaptor region. In some embodiments, the adaptor region comprises a sequence used to identify each probe.

Disclosed herein, in certain embodiments, is a non-transitory computer-readable medium with instructions stored thereon, that when executed by a processor, perform the steps comprising:
a. generating CpG methylation data from a set of biological samples by a sequencing method, wherein the set comprises a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different;
b. obtaining a first pair of CpG methylation datasets, with a first processor, generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
c. obtaining a second pair of CpG methylation datasets, with the first computing device, generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different;
d. obtaining a third pair of CpG methylation datasets, with the first computing device, generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different;
e. generating a pair-wise methylation difference dataset, with a second processor, from the first, second, and third pair of datasets; and
f. analyzing the pair-wise methylation difference dataset with a control dataset by a machine learning method to generate the cancer CpG methylation profile database, wherein
(1) the machine learning method comprises: identifying a plurality of markers and a plurality of weights based on a top score, and classifying the samples based on the plurality of markers and the plurality of weights; and (2) the cancer CpG methylation profile database comprises a set of CpG methylation profiles and each CpG methylation profile represents a cancer type.

In some embodiments, step e) further comprises (a) calculating a difference between the first dataset and the second dataset within the first pair of datasets; (b) calculating a difference between the third dataset and the fourth dataset within the second pair of datasets; and (c) calculating a difference between the fifth dataset and the sixth dataset within the third pair of datasets. In some embodiments, step e) further comprises generating the pair-wise methylation difference dataset, with the second processor, from the calculated difference of the first pair of datasets, the calculated difference of the second pair of datasets, and the calculated difference of the third pair of dataset.

In some embodiments, the machine learning method comprises a semi-supervised learning method or an unsupervised learning method. In some embodiments, the machine learning method utilizes an algorithm selected from one or more of the following: a principal component analysis, a logistic regression analysis, a nearest neighbor analysis, a support vector machine, and a neural network model.

In some embodiments, the CpG methylation data is generated from an extracted genomic DNA treated with a deaminating agent.

In some embodiments, the methylation profile comprises at least 10, 20, 30, 40, 50, 100, 200, or more of biomarkers selected from the group consisting of Tables 8-41 or Tables 56-59.

In some embodiments, the cancer type is a solid cancer type or a hematologic malignant cancer type. In some embodiments, the cancer type is a relapsed or refractory cancer type. In some embodiments, the cancer type comprises acute myeloid leukemia (LAML or AML), acute lymphoblastic leukemia (ALL), adrenocortical carcinoma (ACC), bladder urothelial cancer (BLCA), brain stem glioma, brain lower grade glioma (LGG), brain tumor, breast cancer (BRCA), bronchial tumors, Burkitt lymphoma, cancer of unknown primary site, carcinoid tumor, carcinoma of unknown primary site, central nervous system atypical teratoid/rhabdoid tumor, central nervous system embryonal tumors, cervical squamous cell carcinoma, endocervical adenocarcinoma (CESC) cancer, childhood cancers, cholangiocarcinoma (CHOL), chordoma, chronic lymphocytic leukemia, chronic myelogenous leukemia, chronic myeloproliferative disorders, colon (adenocarcinoma) cancer (COAD), colorectal cancer, craniopharyngioma, cutaneous T-cell lymphoma, endocrine pancreas islet cell tumors, endometrial cancer, ependymoblastoma, ependymoma, esophageal cancer (ESCA), esthesioneuroblastoma, Ewing sarcoma, extracranial germ cell tumor, extragonadal germ cell tumor, extrahepatic bile duct cancer, gallbladder cancer, gastric (stomach) cancer, gastrointestinal carcinoid tumor, gastrointestinal stromal cell tumor, gastrointestinal stromal tumor (GIST), gestational trophoblastic tumor, glioblstoma multiforme glioma GBM), hairy cell leukemia, head and neck cancer (HNSD), heart cancer, Hodgkin lymphoma, hypopharyngeal cancer, intraocular melanoma, islet cell tumors, Kaposi sarcoma, kidney cancer, Langerhans cell histiocytosis, laryngeal cancer, lip cancer, liver cancer, Lymphoid Neoplasm Diffuse Large B-cell Lymphoma [DLBCL], malignant fibrous histiocytoma bone cancer, medulloblastoma, medullo epithelioma, melanoma, Merkel cell carcinoma, Merkel cell skin carcinoma, mesothelioma (MESO), metastatic squamous neck cancer with occult primary, mouth cancer, multiple endocrine neoplasia syndromes, multiple myeloma, multiple myeloma/plasma cell neoplasm, mycosis fungoides, myelodysplastic syndromes, myeloproliferative neoplasms, nasal cavity cancer, nasopharyngeal cancer, neuroblastoma, Non-Hodgkin lymphoma, nonmelanoma skin cancer, non-small cell lung cancer, oral cancer, oral cavity cancer, oropharyngeal cancer, osteosarcoma, other brain and spinal cord tumors, ovarian cancer, ovarian epithelial cancer, ovarian germ cell tumor, ovarian low malignant potential tumor, pancreatic cancer, papillomatosis, paranasal sinus cancer, parathyroid cancer, pelvic cancer, penile cancer, pharyngeal cancer, pheochromocytoma and paraganglioma (PCPG), pineal parenchymal tumors of intermediate differentiation, pineoblastoma, pituitary tumor, plasma cell neoplasm/multiple myeloma, pleuropulmonary blastoma, primary central nervous system (CNS) lymphoma, primary hepatocellular liver cancer, prostate cancer such as prostate adenocarcinoma (PRAD), rectal cancer, renal cancer, renal cell (kidney) cancer, renal cell cancer, respiratory tract cancer, retinoblastoma, rhabdomyosarcoma, salivary gland cancer, sarcoma (SARC), Sezary syndrome, skin cutaneous melanoma (SKCM), small cell lung cancer, small intestine cancer, soft tissue sarcoma, squamous cell carcinoma, squamous neck cancer, stomach (gastric) cancer, supratentorial primitive neuroectodermal tumors, T-cell lymphoma, testicular cancer testicular germ cell tumors (TGCT), throat cancer, thymic carcinoma, thymoma (THYM), thyroid cancer (THCA), transitional cell cancer, transitional cell cancer of the renal pelvis and ureter, trophoblastic tumor, ureter cancer, urethral cancer, uterine cancer, uterine cancer, uveal melanoma (UVM), vaginal cancer, vulvar cancer, Waldenstrom macroglobulinemia, or Wilm's tumor. In some embodiments, the cancer type comprises acute lymphoblastic leukemia, acute myeloid leukemia, bladder cancer, breast cancer, brain cancer, cervical cancer, cholangiocarcinoma, colon cancer, colorectal cancer, endometrial cancer, esophageal cancer, gastrointestinal cancer, glioma, glioblastoma, head and neck cancer, kidney cancer, liver cancer, lung cancer, lymphoid neoplasia, melanoma, a myeloid neoplasia, ovarian cancer, pancreatic cancer, pheochromocytoma and paraganglioma, prostate cancer, rectal cancer, squamous cell carcinoma, testicular cancer, stomach cancer, or thyroid cancer.

In some embodiments, the control dataset comprises a set of methylation profiles, wherein each said methylation profile is generated from a biological sample obtained from a known cancer type.

In some embodiments, the biological samples comprise a cell-free biological sample. In some embodiments, the biological samples comprise a circulating tumor DNA sample. In some embodiments, the biological samples comprise a biopsy sample. In some embodiments, the biological samples comprise a tissue sample.

Disclosed herein, in certain embodiments, also include a kit that comprises a probe panel described above.

Disclosed herein, in certain embodiments, further include a service that comprises a computer-implemented method described above.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings. The patent application file contains at least one drawing executed in color. Copies of this patent application publication with color drawing(s) will be provided by the Office upon request and payment of the necessary fee.

FIG. 11A illustrates unsupervised hierarchical clustering and heat maps associated with the methylation profile and drive genes mutation in LGG. FIG. 11B shows a 5-years survival curve of patients with LGG according to the combination of PCA value and IDH mutation. FIG. 11C illustrates unsupervised hierarchical clustering and heat maps associated with the methylation profile and frequently mutated genes in LIHC. FIG. 11D illustrates unsupervised hierarchical clustering and heat maps associated with the methylation profile and frequently mutated genes in KIRC.

FIG. 15A-FIG. 15J illustrate the effect of an engineered gene on inhibition of breast cancer cell line growth. The engineered gene was transduced into a breast cancer cell lines. FIG. 15A and FIG. 15F illustrate respective CpG methylation sites. FIG. 15B and FIG. 15G shows resected and measured tumors after the engineered gene transduced or control cells were implanted in nude mice. FIG. 15D and FIG. 15I show quantified growth of these tumors over time. FIG. 15C, FIG. 15E, FIG. 15H, and FIG. 15J show colony formation in vitro by engineered gene transduced cells versus control.

FIG. 18 illustrates DNA methylation signatures associated with primary and metastatic colon cancer, liver cancer and lung cancer in a Chinese cohort. Unsupervised hierarchical clustering and heat map associated with the methylation profile of the 567 primary tumor specimens based on the 104 markers.

FIG. 19A shows a 5-year survival rate stratified according to methylation profiles. The group with PcaValue>0 (n=127) has improved survival probability (81.2%) than that of (42%) PcaValue<0 (n=145) (P=0.007). FIG. 19B shows a 5-year survival rates in stage I-II patients stratified according to methylation profiling, the group with PcaValue>0 (n=73) has improved survival probability (100%) than that of (51.3%), PcaValue<0 (n=77) (P=0.007). FIG. 19C shows a 5-year survival rates in stage III-IV patients stratified according to methylation profiling, the group with PcaValue>0 (n=49) has improved survival probability (81.1%) than that of (42%) PcaValue<0 (n=66) (P=0.01). FIG. 19D shows a 5-year survival rates in stage II patients stratified according to methylation profiling, the group with PcaValue>0 (n=51) has improved survival probability (100%) than that of (53.4%) PcaValue<0 (n=58) (P=0.029). FIG. 19E shows a 5-year survival rates in stage III patients stratified according to methylation profiling, the group with PcaValue>0 (n=34) has improved survival probability (94.1%) than that of (57.2%) PcaValue<0 (n=46) (P=0.021).

FIG. 20A-FIG. 20E illustrate methylation based survival classification correlated with driver mutation status. FIG. 20A illustrates a 5-years survival curve of patients with COAD according to PCAvalue. FIG. 20B shows a 5-years survival curve of patients with COAD according to gene mutation. FIG. 20C illustrates 5-years survival curve of patients with COAD according to the combination of PCAvalue and gene mutation. FIG. 20D shows unsupervised hierarchical clustering and heat maps associated with the methylation profile and frequently mutated genes in COAD. FIG. 20E illustrates P values of genes significantly associated with overall survival.

FIG. 21 illustrates patient cohort characteristics.

FIG. 23A-FIG. 23E illustrate effect of PCDH17 on inhibition of colon cancer cell line growth. PCDH17 was transduced into HCT116 cells. FIG. 23A illustrate CpG methylation profiles. FIG. 23B shows resected and measured tumors after engineered gene transduced or control cells were implanted in nude mice. FIG. 23D shows quantified growth of these tumors over time. FIG. 23C and FIG. 23D show colony formation in vitro by engineered gene transduced cells versus control.

FIG. 28A shows methylation markers which can predict five-year overall survival of patients with AML and FIG. 28B shows methylation markers which can predict five-year overall survival of patients with ALL.

FIG. 31A shows the methylated regions of genomic cfDNA and FIG. 31B illustrates the non-methylated regions of the genomic cfDNA. FIG. 31C illustrates the methylation ratios of CpG site cg10673833 from three patients (2043089, 2042981, and 2004651), normal cfDNA reference sample, primary colon tissue reference sample, and normal blood reference sample. Patients 2043089 and 2042981 have primary colon cancer, and Patient 2004651 has metastatic colon cancer.

FIG. 32A shows the methylation ratio of CpG site cg00401797 in liver cancer cfDNA sample, normal cfDNA sample, primary liver cancer tissue reference sample (genomic DNA), and normal lymphocyte reference sample (genomic DNA). FIG. 32B shows the methylation ratio of CpG site cg07519236 in breast cancer cfDNA sample, normal cfDNA sample, primary breast cancer tissue reference sample (genomic DNA), and normal lymphocyte reference sample (genomic DNA). FIG. 32C shows the methylation ratio of CpG site cg02877575 in lung cancer cfDNA sample, normal cfDNA sample, primary lung cancer tissue reference sample (genomic DNA), and normal lymphocyte reference sample (genomic DNA).

FIG. 33A shows probe Cob-2 which targets the CpG site cg10673833 and the methylation profiles from the cfDNA samples of three colon cancer patients, normal cfDNA sample, primary colon cancer tissue reference sample (genomic DNA), and normal lymphocyte reference sample (genomic DNA). Two of the three patients (2043089 and 2042981) have primary colon cancer. The remainder patient (2004651) has metastatic colon cancer. FIG. 33B shows probe Brb-2 which targets the CpG site cg07974511 and the methylation profiles from the cfDNA samples of two primary colon cancer patients (2043089 and 2042981), normal cfDNA sample, primary colon cancer tissue reference sample (genomic DNA), and normal lymphocyte reference sample (genomic DNA).

DETAILED DESCRIPTION OF THE INVENTION

Figure 1A:
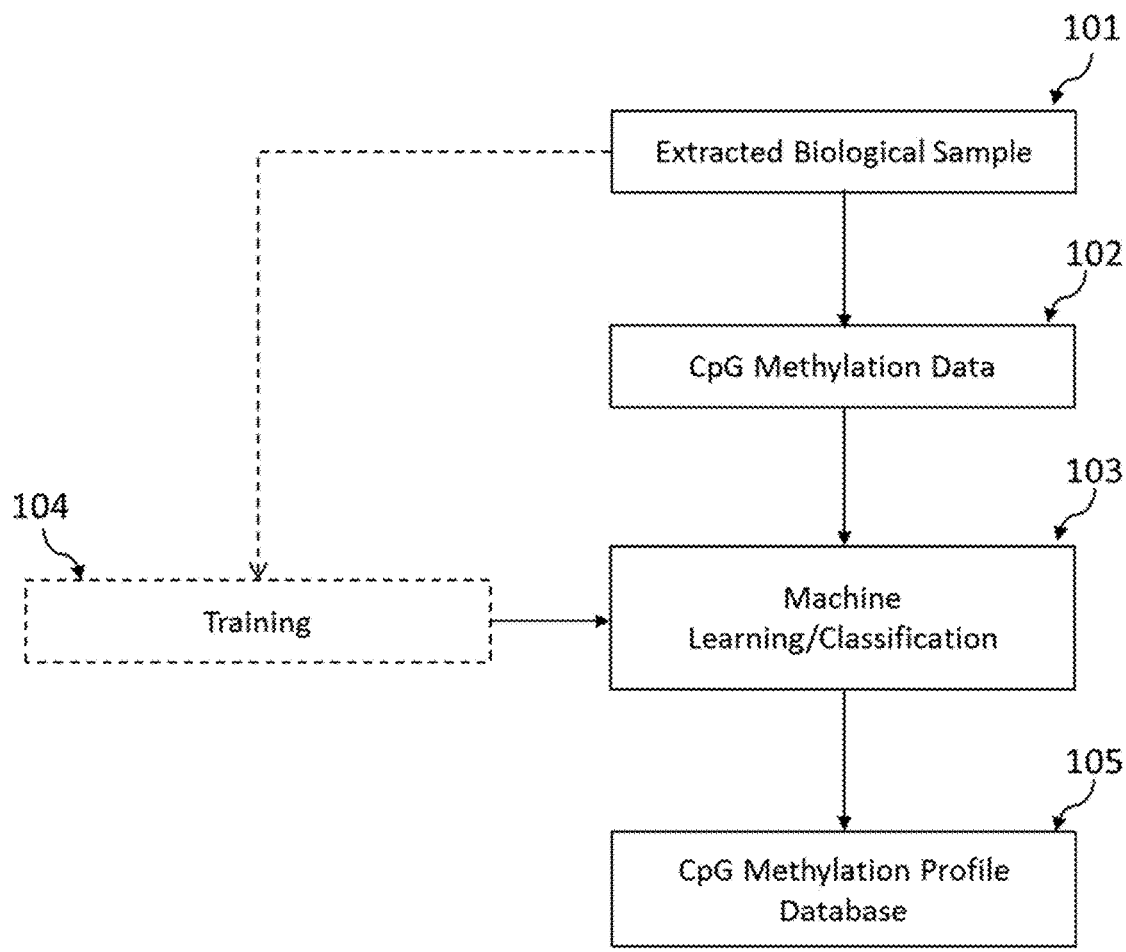
FIG. 1A and FIG. 1B illustrate an overview of a method, a platform, and a system disclosed herein.

Cancer is characterized by an abnormal growth of a cell caused by one or more mutations or modifications of a gene leading to dysregulated balance of cell proliferation and cell death. DNA methylation silences expression of tumor suppression genes, and presents itself as one of the first neoplastic changes. Methylation patterns found in neoplastic tissue and plasma demonstrate homogeneity, and in some instances are utilized as a sensitive diagnostic marker. For example, cMethDNA assay has been shown in one study to be about 91% sensitive and about 96% specific when used to diagnose metastatic breast cancer. In another study, circulating tumor DNA (ctDNA) was about 87.2% sensitive and about 99.2% specific when it was used to identify KRAS gene mutation in a large cohort of patients with metastatic colon cancer (Bettegowda et al., Detection of Circulating Tumor DNA in Early- and Late-Stage Human Malignancies. Sci. Transl. Med, 6(224):ra24. 2014). The same study further demonstrated that ctDNA is detectable in >75% of patients with advanced pancreatic, ovarian, colorectal, bladder, gastroesophageal, breast, melanoma, hepatocellular, and head and neck cancers (Bettegowda et al).

Additional studies have demonstrated that CpG methylation pattern correlates with neoplastic progression. For example, in one study of breast cancer methylation patterns, P16 hypermethylation has been found to correlate with early stage breast cancer, while TIMP3 promoter hypermethylation has been correlated with late stage breast cancer. In addition, BMP6, CST6 and TIMP3 promoter hypermethylation have been shown to associate with metastasis into lymph nodes in breast cancer.

In some embodiments, DNA methylation profiling provides higher clinical sensitivity and dynamic range compared to somatic mutation analysis for cancer detection. In other instances, altered DNA methylation signature has been shown to correlate with the prognosis of treatment response for certain cancers. For example, one study illustrated that in a group of patients with advanced rectal cancer, ten differentially methylated regions were used to predict patients' prognosis. Likewise, RASSF1A DNA methylation measurement in serum was used to predict a poor outcome in patients undergoing adjuvant therapy in breast cancer patients in a different study. In addition, SRBC gene hypermethylation was associated with poor outcome in patients with colorectal cancer treated with oxaliplatin in a different study. Another study has demonstrated that ESR1 gene methylation correlate with clinical response in breast cancer patients receiving tamoxifen. Additionally, ARHI gene promoter hypermethylation was shown to be a predictor of long-term survival in breast cancer patients not treated with tamoxifen.

In some instances, DNA methylation profiling assays are tailored to specific cancer types. In some cases, DNA methylation profiling assays do not distinguish different cancer types under a pan-cancer setting. In additional instances, under low sample concentration conditions (e.g., in ng concentration condition), DNA methylation profiling assays lack reproducibility and have lowered sensitivity when compared to higher sample concentration conditions.

Disclosed herein are methods, systems, platform, non-transitory computer-readable medium, services, and kits for determining a cancer type in an individual. In some embodiments, also described herein include methods, systems, platform, non-transitory computer-readable medium, services, and kits for early detection of cancer. In additional embodiments, described herein include methods, systems, non-transitory computer-readable medium, services, and kits for non-invasive detection of cancer. In still additional embodiments, described herein include methods, systems, platform, non-transitory computer-readable medium, services, and kits for distinguishing different cancer stages. In other embodiments, described herein include methods, systems, platform, non-transitory computer-readable medium, services, and kits for determining the prognosis of a cancer in an individual in need thereof, prediction of a treatment response, and treatment response monitoring. In further embodiments, described herein include methods, systems, platform, non-transitory computer-readable medium, services, and kits for generating a CpG methylation profile database, and probes used in generating CpG methylation data.

Determination of a Patient's Cancer Status

DNA methylation is the attachment of a methyl group at the C5-position of the nucleotide base cytosine and the N6-position of adenine. Methylation of adenine primarily occurs in prokaryotes, while methylation of cytosine occurs in both prokaryotes and eukaryotes. In some instances, methylation of cytosine occurs in the CpG dinucleotides motif. In other instances, cytosine methylation occurs in, for example CHG and CHH motifs, where H is adenine, cytosine or thymine. In some instances, one or more CpG dinucleotide motif or CpG site forms a CpG island, a short DNA sequence rich in CpG dinucleotide. In some instances, a CpG island is present in the 5' region of about one half of all human genes. CpG islands are typically, but not always, between about 0.2 to about 1 kb in length. Cytosine methylation further comprises 5-methylcytosine (5-mCyt) and 5-hydroxymethylcytosine.

The CpG (cytosine-phosphate-guanine) or CG motif refers to regions of a DNA molecule where a cytosine nucleotide occurs next to a guanine nucleotide in the linear strand. In some instances, a cytosine in a CpG dinucleotide is methylated to form 5-methylcytosine. In some instances, a cytosine in a CpG dinucleotide is methylated to form 5-hydroxymethylcytosine.

CpG Methylation Profile Database

In some embodiments, a plurality of CpG methylation data are generated and integrated into a CpG methylation profile database. In some instances, the CpG methylation profile database is utilized as a reference database with a method, a system, a non-transitory computer-readable medium, a service, or a kit described herein. In some instances, the CpG methylation profile database contains a library of CpG methylation profiles, in which each CpG methylation profile correlates to a cancer type (e.g., breast cancer, colorectal cancer, brain cancer, and the like). In some cases, each said CpG methylation profile further correlates to a cancer subtype (e.g., triple-negative breast cancer, colorectal adenocarcinoma, astrocytomas, and the like).

In some embodiments, a CpG methylation profile database is generated as illustrated in FIG. 1A. In some instances, genomic DNA (e.g., nuclear DNA or circulating DNA) is isolated from a biological sample, and then treated by a deaminating agent to generate an extracted genomic DNA (101). In some instances, the extracted genomic DNA (e.g., extracted nuclear DNA or extracted circulating DNA) is optionally treated with one or more restriction enzymes to generate a set of DNA fragments prior to submitting for sequencing analysis to generate CpG methylation data (102). The CpG methylation data is then input into a machine learning/classification program (103) to generate a CpG methylation profile database (105).

In some instances, a set of biological samples are generated and subsequently input into the machine learning/classification program (103). In some instances, the set of biological samples comprises 2, 3, 4, 5, 6, 7, 8, 9, 10, 20, 30, or more biological samples. In some instances, the set of biological samples comprises 2, 3, 4, 5, 6, 7, 8, 9, 10, 20, 30, or more normal biological samples. In some instances, the set of biological samples comprises 2, 3, 4, 5, 6, 7, 8, 9, 10, 20, 30, or more cancerous biological samples. In some cases, the set of biological samples comprise a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different. In some cases, three pairs of datasets are generated in which the three pairs of dataset comprise a first pair of CpG methylation datasets generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source; a second pair of CpG methylation datasets generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different; and a third pair of CpG methylation datasets generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different. In some instances, a difference within each said pair of dataset is calculated and the differences are then input into the machine learning/classification program (103). In some cases, a pair-wise methylation difference dataset from the first, second, and third pair of datasets is generated and then analyzed in the presence of a control dataset or a training dataset (104) by the machine learning/classification method (103) to generate the cancer CpG methylation profile database (105). In some cases, the machine learning method comprises identifying a plurality of markers and a plurality of weights based on a top score (e.g., a t-test value, a β test value), and classifying the samples based on the plurality of markers and the plurality of weights. In some cases, the cancer CpG methylation profile database (105) comprises a set of CpG methylation profiles and each CpG methylation profile represents a cancer type.

Figure 1B:
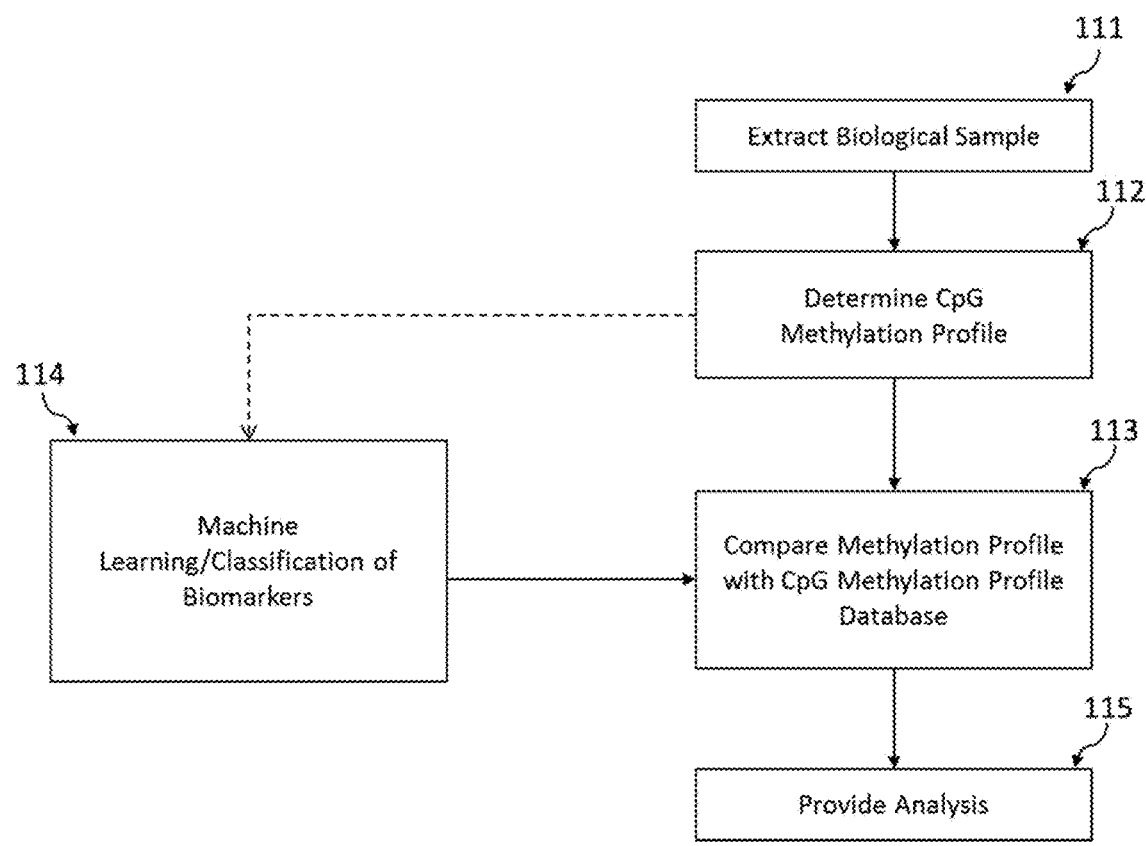

In some embodiments, the CpG methylation profile database is used as a reference database for the diagnosis of a cancer type. In some instances, use of the CpG methylation profile database as a reference database for cancer diagnosis is as illustrated in FIG. 1B. In some instances, genomic DNA (e.g., nuclear DNA or circulating DNA) is isolated from a biological sample, and then treated by a deaminating agent to generate an extracted genomic DNA (111). In some instances, the extracted genomic DNA (e.g., extracted nuclear DNA or extracted circulating DNA) is optionally treated with one or more restriction enzymes to generate a set of DNA fragments prior to submitting for sequencing analysis to generate CpG methylation data. The CpG methylation data is further analyzed and compiled into a CpG methylation profile of interest (112). The CpG methylation profile of interest is optionally inputted into a machine learning/classification program (114) and then compared to CpG methylation profiles within the CpG methylation profile database (115). A match between a CpG methylation profile within the CpG methylation profile database and the CpG methylation profile of interest indicates a cancer type.

In some instances, the CpG methylation profile database is further used as a reference database for determining a primary cancer from a metastatic cancer subtype or for monitoring the progression of a cancer.

In some embodiments, the CpG methylation profile database is generated from CpG methylation data of a biopsy sample. In some instances, the CpG methylation profile database is generated from CpG methylation data of a tissue sample. In some instances, the CpG methylation profile database is generated from CpG methylation data from a cell-free biological sample. In some instances, the CpG methylation profile database is generated from CpG methylation data from a circulating tumor DNA (ctDNA) sample.

Biomarkers

In some embodiments, biomarkers (or markers) described herein are differentially methylated in cancer when compared to normal tissue. In some embodiments, a biomarker indicates or represents a methylation signature, such as for example, a CpG methylation site, a methylation status, a methylation index, or a methylation profile. In some instances, a panel of biomarkers illustrates a collection of methylation signatures to generate, such as for example, a methylation profile, the methylation of one or more genes, and the like. In some cases, biomarkers are utilized individually or collectively as diagnostic tool, or in combination or transformed as a biomarker panel. In some embodiments, biomarkers are assessed within one or more genes, in some cases further compared with the methylation profile of the one or more genes such as reference methylation profiles, leading to characterization of cancer status.

In some embodiments, described herein are methods, systems, platform, and non-transitory computer-readable medium for determining a cancer type based on the methylation profile or the methylation signature of one or more biomarkers. In some embodiments, one or more biomarkers are utilized for early detection of cancer. In additional embodiments, one or more biomarkers are used for non-invasive detection of cancer. In still additional embodiments, one or more biomarkers are used for distinguishing different cancer stages. In other embodiments, one or more biomarkers are used for determining the prognosis of a cancer, prediction of a treatment response, and/or monitoring a treatment response.

In some embodiments, also described herein are methods, systems, platform, and non-transitory computer-readable medium for generating a CpG methylation profile database. In some embodiments, one or more biomarkers are utilized for generating the CpG methylation profile database.

In some embodiments, a biomarker described herein include those shown in Table 1 (an exemplary 5000 marker panel) or Table 42 (an exemplary 1000 marker panel). In some embodiments, a biomarker described herein include those disclosed in Tables 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59. In some embodiments, a method, system, or non-transitory computer-readable medium described herein uses one or more of the biomarkers of Tables 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59 for determining a cancer type. In some embodiments, a method, system, or non-transitory computer-readable medium described herein uses one or more of the biomarkers of Tables 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59 for early detection of cancer. In additional embodiments, a method, system, or non-transitory computer-readable medium described herein uses one or more of the biomarkers of Tables 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59 for non-invasive detection of cancer. In still additional embodiments, a method, system, or non-transitory computer-readable medium described herein uses one or more of the biomarkers of Tables 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59 for distinguishing different stages of cancer. In other embodiments, a method, system, or non-transitory computer-readable medium described herein uses one or more of the biomarkers of Tables 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 41, 42, 56, 57, 58, and 59 for determining the prognosis of a cancer, prediction of a treatment response, and/or monitoring a treatment response.

In some embodiments, a panel comprises one or more of the biomarkers described herein. In some instances, a panel comprises one or more biomarkers selected from Table 1 or Table 42. In some instances, a panel comprises one or more biomarkers selected from Tables 1-42 or Tables 56-59. Alternatively, biomarkers for various biomarker panels are optionally chosen from Tables 8-41. Alternatively, biomarkers for various biomarker panels are optionally chosen from Tables 56, 57, 58, and/or 59. In some instances, Tables 8-41 represent cancer or normal sample marker panels. In some cases, Tables 56 and 57 represent cancer sample marker panels. In some cases, Tables 58, and 59 represent cancer sample marker panels.

In some embodiments, a panel comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers. In some instances, a panel comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers, wherein the biomarkers are selected from Tables 1-42 and 56-59. In some instances, a panel comprises about 5 or more biomarkers, including 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers or markers selected from any of Tables 1-42 and 56-59.

In some embodiments, a panel comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers, wherein the biomarkers are selected from Tables 8-41. In some instances, a panel comprises about 5 or more biomarkers, including 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers or markers selected from any of Tables 8-41.

In some embodiments, a panel comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers, wherein the biomarkers are selected from Tables 56-59. In some instances, a panel comprises about 5 or more biomarkers, including 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers or markers selected from any of Tables 56-59.

In some embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59 for determining a cancer type. In some embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59 for early detection of cancer. In additional embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59 for non-invasive detection of cancer. In still additional embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59 for distinguishing different stages of cancer. In other embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59 for determining the prognosis of a cancer, prediction of a treatment response, and/or monitoring a treatment response.

In some embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59 for determining a cancer type. In some embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59 for early detection of cancer. In additional embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59 for non-invasive detection of cancer. In still additional embodiments, a method, a system, platform, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59 for distinguishing different stages of cancer. In other embodiments, a method, a system, or a non-transitory computer-readable medium described herein uses a panel that comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59 for determining the prognosis of a cancer, prediction of a treatment response, and/or monitoring a treatment response.

In some embodiments, a CpG methylation profile database comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 1-42, Tables 8-41, or Tables 56-59. In some embodiments, a CpG methylation profile database comprises 1, 2, 3, 4, 5, 6, 7, 8, 9, 10, 11, 12, 13, 14, 15, 16, 17, 18, 19, 20, 21, 22, 23, 24, 25, 26, 27, 28 29, 30, 31, 32, 33, 34, 35, 36, 37, 38, 39, 40, 45, 50, 55, 60, 65, 70, 75, 80, 85, 90, 95, 100, 105, 110, 115, 120, 125, 150, 175, 200, 225, 250, 275, 300, 325, 350, 375, 400, 425, 450, 475, 500, 550, 600, 650, 700, 750, 800, 850, 900, 950, 1000 or more biomarkers selected from Tables 56-59.

Methylation Profile

A methylation profile described herein refers to a set of data representing the methylation states or levels of one or more biomarker (or loci) within a molecule of DNA. In some instances, a methylation profile described herein refers to a set of data representing the methylation states or levels of one or more biomarkers of Tables 1-42. In some cases, a methylation profile described herein refers to a set of data representing the methylation states or levels of one or more biomarkers of Tables 8-41. In additional cases, a methylation profile described herein refers to a set of data representing the methylation states or levels of one or more biomarkers of Tables 56-59. In some instances, DNA methylation data includes, but is not limited to, a methylation index of a CpG site, a methylation density of CpG sites in a region, a distribution of CpG sites over a contiguous region, a pattern or level of methylation for one or more individual CpG site(s) within a region that contains more than one CpG site, absence of CpG methylation, and/or non-CpG methylation. In some instances, a methylation profile comprises a set of methylation index of a CpG site, a set of methylation density of CpG sites in a region, a set of distribution of CpG sites over a contiguous region, a set of pattern or level of methylation of one or more individual CpG site(s) within a region that contains more than one CpG site, a set of absent CpG methylation, a set of non-CpG methylation, or a combination thereof. In some instances, a methylation profile is also referred to herein as a methylation fingerprint or a methylation signature.

In some embodiments, a methylation profile comprises the methylation states or levels of a panel of biomarkers selected from Tables 1-42, Tables 8-41, or Tables 56-59. In some instances, a methylation profile that comprises the methylation states or levels of a panel of biomarkers selected from Tables 1-42, Tables 8-41, or Tables 56-59 is used by a method, a system, platform, or a non-transitory computer-readable medium to determine a cancer type. In some cases, a methylation profile that comprises the methylation states or levels of a panel of biomarkers selected from Tables 1-42, Tables 8-41, or Tables 56-59 is used by a method, a system, platform, or a non-transitory computer-readable medium for early detection of cancer. In some cases, a methylation profile that comprises the methylation states or levels of a panel of biomarkers selected from Tables 1-42, Tables 8-41, or Tables 56-59 is used by a method, a system, platform, or a non-transitory computer-readable medium for detection of presence of cancer. In some instances, a methylation profile that comprises the methylation states or levels of a panel of biomarkers selected from Tables 1-42, Tables 8-41, or Tables 56-59 is used by a method, a system, platform, or a non-transitory computer-readable medium for non-invasive detection of cancer. In some instances, a methylation profile that comprises the methylation states or levels of a panel of biomarkers selected from Tables 1-42, Tables 8-41, or Tables 56-59 is used by a method, a system, platform, or a non-transitory computer-readable medium for distinguishing different cancer stages. In some instances, a methylation profile that comprises the methylation states or levels of a panel of biomarkers selected from Tables 1-42, Tables 8-41, or Tables 56-59 is used by a method, a system, platform, or a non-transitory computer-readable medium to determine the prognosis of a cancer, to predict a treatment response, and/or to monitor a treatment response.

In some embodiments, the methylation states or levels of a panel of biomarkers selected from Tables 1-42, Tables 8-41, or Tables 56-59 are generated from a tissue sample. In some instances, the methylation states or levels of a panel of biomarkers selected from Tables 1-42, Tables 8-41, or Tables 56-59 are generated from a cell-free DNA (cfDNA) sample. In some cases, the methylation states or levels of a panel of biomarkers selected from Tables 1-42, Tables 8-41, or Tables 56-59 are generated from a circulating tumor DNA (ctDNA) sample.

In some embodiments, a methylation profile that comprises the methylation states or levels of a panel of biomarkers selected from Tables 56-59 is used by a method, a system, platform, or a non-transitory computer-readable medium to determine a cancer type. In some embodiments, a methylation profile that comprises the methylation states or levels of a panel of biomarkers selected from Tables 56-58 is used by a method, a system, platform, or a non-transitory computer-readable medium to determine a cancer type. In some embodiments, a methylation profile that comprises the methylation states or levels of a panel of biomarkers selected from Tables 57-58 is used by a method, a system, platform, or a non-transitory computer-readable medium to determine a cancer type.

In some embodiments, a methylation profile that comprises the methylation states or levels of a panel of biomarkers selected from Table 56 is used by a method, a system, platform, or a non-transitory computer-readable medium to determine a cancer type. In some instances, a methylation profile that comprises the methylation states or levels of a panel of biomarkers selected from Table 57 is used by a method, a system, platform, or a non-transitory computer-readable medium to determine a cancer type. In some cases, a methylation profile that comprises the methylation states or levels of a panel of biomarkers selected from Table 58 is used by a method, a system, platform, or a non-transitory computer-readable medium to determine a cancer type. In some embodiments, a methylation profile that comprises the methylation states or levels of a panel of biomarkers selected from Table 59 is used by a method, a system, platform, or a non-transitory computer-readable medium to determine a cancer type.

In some embodiments, a methylation profile that comprises the methylation states or levels of a panel of biomarkers selected from Tables 8-41, 56-59, 56-58, or 57-58 is used by a method, a system, platform, or a non-transitory computer-readable medium to detect the presence of cancer in a biological sample. In some instances, this is followed by a second methylation profile that comprises the methylation states or levels of a panel of biomarkers selected from Tables 8-41, 56-59, 56-58, or 57-58 which is used by a method, a system, platform, or a non-transitory computer-readable medium to determine a cancer type.

In some instances, a methylation profile that encompasses more than 30%, 40%, 50%, 60%, 70%, 80%, 90%, 95%, or more of the genome is considered as a methylome. In some instances, a methylome is generated from a panel of biomarkers selected from Tables 1-42, Tables 8-41, or Tables 56-59. In some cases, a method, a system, platform, or a non-transitory computer-readable medium uses a methylome described herein to determine a cancer type. In additional cases, a method, a system, or a non-transitory computer-readable medium uses a methylome described herein for early detection of cancer. In some instances, a method, a system, platform, or a non-transitory computer-readable medium uses a methylome described herein for non-invasive detection of cancer. In additional instances, a method, a system, or a non-transitory computer-readable medium uses a methylome described herein for distinguishing different cancer stages. In still additional instances, a method, a system, platform, or a non-transitory computer-readable medium uses a methylome described herein to determine the prognosis of a cancer, to predict a treatment response, and/or to monitor a treatment response.

In some instances, a methylation status or methylation level indicates the presence, absence and/or quantity of methylation at a particular nucleotide, or nucleotides within a portion of DNA. In some instances, the methylation status of a particular DNA sequence (e.g., a biomarker or DNA region as described herein) indicates the methylation state of every base in the sequence or can indicate the methylation state of a subset of the base pairs (e.g., of cytosines or the methylation state of one or more specific restriction enzyme recognition sequences) within the sequence, or can indicate information regarding regional methylation density within the sequence without providing precise information of where in the sequence the methylation occurs. In some embodiments, the methylation status/levels are used to differentiate between different subtypes or tumor entities. In some instances, specific DNA methylation patterns distinguish tumors with low and high metastatic potential, thereby allowing tailoring of a treatment regimen.

In some instances, the methylation status at one or more CpG methylation sites within a DNA sequence include unmethylated, fully-methylated and/or hemimethylated site. In some cases, a collection of methylation profiles is used to create a methylation panel, for example, to represent the methylation profiles for a group of individuals or for a tumor type or characteristic. In some instances, hypermethylation is the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample. In some cases, hypomethylation is the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

In some embodiments, the methylation index for each genomic site (e.g., a CpG site) refers to the proportion of sequence reads showing methylation at the site over the total number of reads covering that site. In some instances, the methylation density of a region is the number of reads at sites within the region showing methylation divided by the total number of reads covering the sites in the region. In some cases, the CpG methylation density of a region is the number of reads showing CpG methylation divided by the total number of reads covering CpG sites in the region (e.g., a particular CpG site, CpG sites within a CpG island, or a larger region). For example, the methylation density for each 100-kb bin in the human genome is determined from the total number of unconverted cytosines (which corresponds to methylated cytosine) at CpG sites as a proportion of all CpG sites covered by sequence reads mapped to the 100-kb region. In some cases, this analysis is also performed for other bin sizes, e.g. 50-kb or 1-Mb, etc. In some instances, a region is the entire genome or a chromosome or part of a chromosome (e.g. a chromosomal arm). In some cases, the methylation index of a CpG site is the same as the methylation density for a region when the region only includes that CpG site. In some cases, proportion of methylated cytosines refers the number of cytosine sites, "C's", that are shown to be methylated (for example unconverted after a deamination treatment such as a bisulfite conversion) over the total number of analyzed cytosine residues, i.e. including cytosines outside of the CpG context, in the region. In some cases, the methylation index, methylation density and proportion of methylated cytosines are examples of methylation levels.

In some embodiments, the determination of the methylation profile comprises determining the methylation status of more than at least about 1, 5, 10, 15, 20, 25, 30, 35, 40, 50, 75, or 100, 150, 200, 250, 300, 400, 500, 750, 1000, 2000, 2500, 3000, 4000, 5000, 7500, 10000, 20000, 25000, 30000, 40000, 50000, 75000, 100000, 200000, 300000, 400000, 500000, 600000 and 700000 CpG sites from a DNA sample. In one aspect of this embodiment, a methylation profile is generated from the methylation status of about 1 to about 500,000 CpG sites.

In some embodiments, a methylation profile is derived from biopsy sample. In some instances, a methylation profile is derived from a tissue sample. In some instances, a methylation profile is derived from a cell-free biological sample. In some instances, a methylation profile is derived from a circulating tumor DNA (ctDNA) sample.

Control

Various methodologies described herein include a step that involves comparing a value, level, feature, characteristic, property, etc. to a suitable control, referred to interchangeably herein as an appropriate control, a control sample, or as a control. In some embodiments, a control is a value, level, feature, characteristic, property, etc., determined in a cell, a tissue, an organ, or a sample obtained from a patient. In some instances, the cell, tissue, organ, or sample is a normal cell, tissue, organ, or sample. In some cases, the cell tissue, organ, or sample is a cancerous cell, tissue, organ, or sample. For example, the biomarkers of the present invention is assayed for their methylation level in a sample from an unaffected individual or a normal control individual, or the subject's unaffected family member. In another embodiment, a control is a value, level, feature, characteristic, property, etc. determined prior to initiating a therapy (e.g., a cancer treatment) on a patient, or in between a therapeutic regimen. In further embodiments, a control is a predefined value, level, feature, characteristic, property, etc.

In some embodiments, a control is a methylation profile of one or more biomarkers of the present invention that correlates to one type of cancer, to which a patient sample is compared with. In some instances, a control is a methylation profile of one or more biomarkers of Tables 1-42, Tables 8-41, or Tables 56-59. In some instances, a control is a positive control, e.g., a methylation profile obtained from a cancer sample, or is a negative control, e.g., a methylation profile obtained from a normal sample. In some instances, a control is also referred to as a training set or training dataset.

Detection Methods

In some embodiments, a number of methods are utilized to measure, detect, determine, identify, and characterize the methylation status/level of a biomarker (i.e., a region/fragment of DNA or a region/fragment of genome DNA (e.g., CpG island-containing region/fragment)) in the development of a disease or condition (e.g., cancer) and thus diagnose the onset, presence or status of the disease or condition.

In some instances, the methylation profile is generated from a biological sample isolated from an individual. In some embodiments, the biological sample is a biopsy. In some instances, the biological sample is a tissue sample. In other instances, the biological sample is a cell-free biological sample. In other instances, the biological sample is a circulating tumor DNA sample. In one embodiment, the biological sample is a cell free biological sample containing circulating tumor DNA.

In some embodiments, a biomarker (also referred herein as a marker) is obtained from a tissue sample. In some instances, a tissue corresponds to any cell(s). Different types of tissue correspond to different types of cells (e.g., liver, lung, blood, connective tissue, and the like), but also healthy cells vs. tumor cells or to tumor cells at various stages of neoplasia, or to displaced malignant tumor cells. In some embodiments, a tissue sample further encompasses a clinical sample, and also includes cells in culture, cell supernatants, organs, and the like. Samples also comprise fresh-frozen and/or formalin-fixed, paraffin-embedded tissue blocks, such as blocks prepared from clinical or pathological biopsies, prepared for pathological analysis or study by immunohistochemistry.

In some embodiments, a biomarker is obtained from a liquid sample. In some embodiments, the liquid sample comprises blood and other liquid samples of biological origin (including, but not limited to, peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, tears, cyst fluid, pleural and peritoneal fluid, pericardial fluid, ascites, lymph, chyme, chyle, bile, interstitial fluid, menses, pus, sebum, vomit, vaginal secretions/flushing, synovial fluid, mucosal secretion, stool water, pancreatic juice, lavage fluids from sinus cavities, bronchopulmonary aspirates, blastocyl cavity fluid, or umbilical cord blood. In some embodiments, the biological fluid is blood, a blood derivative or a blood fraction, e.g., serum or plasma. In a specific embodiment, a sample comprises a blood sample. In another embodiment, a serum sample is used. In another embodiment, a sample comprises urine. In some embodiments, the liquid sample also encompasses a sample that has been manipulated in any way after their procurement, such as by centrifugation, filtration, precipitation, dialysis, chromatography, treatment with reagents, washed, or enriched for certain cell populations.

In some embodiments, a biomarker is methylated or unmethylated in a normal sample (e.g., normal or control tissue without disease, or normal or control body fluid, stool, blood, serum, amniotic fluid), most importantly in healthy stool, blood, serum, amniotic fluid or other body fluid. In other embodiments, a biomarker is hypomethylated or hypermethylated in a sample from a patient having or at risk of cancer; for example, at a decreased or increased (respectively) methylation frequency of at least about 50%, at least about 60%, at least about 70%, at least about 75%, at least about 80%, at least about 85%, at least about 90%, at least about 95%, or about 100% in comparison to a normal sample. In one embodiment, a sample is also hypomethylated or hypermethylated in comparison to a previously obtained sample analysis of the same patient having or at risk of cancer, particularly to compare progression of a disease.

In some embodiments, a methylome comprises a set of biomarkers, such as a biomarker described above. In some instances, a methylome that corresponds to the methylome of a tumor of an organism (e.g., a human) is classified as a tumor methylome. In some cases, a tumor methylome is determined using tumor tissue or cell-free (or protein-free) tumor DNA in a biological sample. Other examples of methylomes of interest include the methylomes of organs that contribute DNA into a bodily fluid (e.g. methylomes of tissue such as brain, breast, lung, the prostrate and the kidneys, plasma, etc.).

In some embodiments, a plasma methylome is the methylome determined from the plasma or serum of an animal (e.g., a human). In some instances, the plasma methylome is an example of a cell-free or protein-free methylome since plasma and serum include cell-free DNA. The plasma methylome is also an example of a mixed methylome since it is a mixture of tumor and other methylomes of interest. In some instances, the urine methylome is determined from the urine sample of a subject. In some cases, a cellular methylome corresponds to the methylome determined from cells (e.g., tissue cells from an organ such as brain, lung, breast and the like) of the patient. The methylome of the blood cells is called the blood cell methylome (or blood methylome).

In some embodiments, DNA (e.g., genomic DNA such as extracted genomic DNA or treated genomic DNA) is isolated by any means standard in the art, including the use of commercially available kits. Briefly, wherein the DNA of interest is encapsulated in by a cellular membrane the biological sample must be disrupted and lysed by enzymatic, chemical or mechanical means. In some cases, the DNA solution is then cleared of proteins and other contaminants e.g. by digestion with proteinase K. The DNA is then recovered from the solution. In such cases, this is carried out by means of a variety of methods including salting out, organic extraction or binding of the DNA to a solid phase support. In some instances, the choice of method is affected by several factors including time, expense and required quantity of DNA.

Wherein the sample DNA is not enclosed in a membrane (e.g. circulating DNA from a cell free sample such as blood or urine) methods standard in the art for the isolation and/or purification of DNA are optionally employed (See, for example, Bettegowda et al. Detection of Circulating Tumor DNA in Early- and Late-Stage Human Malignancies. Sci. Transl. Med, 6(224): ra24. 2014). Such methods include the use of a protein degenerating reagent e.g. chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. In some cases, the person skilled in the art also make use of devices such as filter devices e.g. ultrafiltration, silica surfaces or membranes, magnetic particles, polystyrol particles, polystyrol surfaces, positively charged surfaces, and positively charged membranes, charged membranes, charged surfaces, charged switch membranes, charged switched surfaces.

In some instances, once the nucleic acids have been extracted, methylation analysis is carried out by any means known in the art. A variety of methylation analysis procedures are known in the art and may be used to practice the invention. These assays allow for determination of the methylation state of one or a plurality of CpG sites within a tissue sample. In addition, these methods may be used for absolute or relative quantification of methylated nucleic acids. Such methylation assays involve, among other techniques, two major steps. The first step is a methylation specific reaction or separation, such as (i) bisulfite treatment, (ii) methylation specific binding, or (iii) methylation specific restriction enzymes. The second major step involves (i) amplification and detection, or (ii) direct detection, by a variety of methods such as (a) PCR (sequence-specific amplification) such as Taqman®, (b) DNA sequencing of untreated and bisulfite-treated DNA, (c) sequencing by ligation of dye-modified probes (including cyclic ligation and cleavage), (d) pyrosequencing, (e) single-molecule sequencing, (f) mass spectroscopy, or (g) Southern blot analysis.

Additionally, restriction enzyme digestion of PCR products amplified from bisulfite-converted DNA may be used, e.g., the method described by Sadri and Hornsby (1996, Nucl. Acids Res. 24:5058-5059), or COBRA (Combined Bisulfite Restriction Analysis) (Xiong and Laird, 1997, Nucleic Acids Res. 25:2532-2534). COBRA analysis is a quantitative methylation assay useful for determining DNA methylation levels at specific gene loci in small amounts of genomic DNA. Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (Frommer et al, 1992, Proc. Nat. Acad. Sci. USA, 89, 1827-1831). PCR amplification of the bisulfite converted DNA is then performed using primers specific for the CpG sites of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from micro-dissected paraffin-embedded tissue samples. Typical reagents (e.g., as might be found in a typical COBRA-based kit) for COBRA analysis may include, but are not limited to: PCR primers for specific gene (or methylation-altered DNA sequence or CpG island); restriction enzyme and appropriate buffer; gene-hybridization oligo; control hybridization oligo; kinase labeling kit for oligo probe; and radioactive nucleotides. Additionally, bisulfite conversion reagents may include: DNA denaturation buffer; sulfo nation buffer; DNA recovery reagents or kits (e.g., precipitation, ultrafiltration, affinity column); desulfonation buffer; and DNA recovery components.

In an embodiment, the methylation profile of selected CpG sites is determined using methylation-Specific PCR (MSP). MSP allows for assessing the methylation status of virtually any group of CpG sites within a CpG island, independent of the use of methylation-sensitive restriction enzymes (Herman et al, 1996, Proc. Nat. Acad. Sci. USA, 93, 9821-9826; U.S. Pat. Nos. 5,786,146, 6,017,704, 6,200, 756, 6,265,171 (Herman and Baylin); U.S. Pat. Pub. No. 2010/0144836 (Van Engeland et al); which are hereby incorporated by reference in their entirety). Briefly, DNA is modified by a deaminating agent such as sodium bisulfite to convert unmethylated, but not methylated cytosines to uracil, and subsequently amplified with primers specific for methylated versus unmethylated DNA. Typical reagents (e.g., as might be found in a typical MSP-based kit) for MSP analysis may include, but are not limited to: methylated and unmethylated PCR primers for specific gene (or methylation-altered DNA sequence or CpG island), optimized PCR buffers and deoxynucleotides, and specific probes. The ColoSure™ test is a commercially available test for colon cancer based on the MSP technology and measurement of methylation of the vimentin gene (Itzkowitz et al, 2007, Clin Gastroenterol. Hepatol. 5(1), 111-117). Alternatively, one may use quantitative multiplexed methylation specific PCR (QM-PCR), as described by Fackler et al. Fackler et al, 2004, Cancer Res. 64(13) 4442-4452; or Fackler et al, 2006, Clin. Cancer Res. 12(11 Pt 1) 3306-3310.

In an embodiment, the methylation profile of selected CpG sites is determined using MethyLight and/or Heavy Methyl Methods. The MethyLight and Heavy Methyl assays are a high-throughput quantitative methylation assay that utilizes fluorescence-based real-time PCR (Taq Man®) technology that requires no further manipulations after the PCR step (Eads, C. A. et al, 2000, Nucleic Acid Res. 28, e 32; Cottrell et al, 2007, J. Urology 177, 1753, U.S. Pat. No. 6,331,393 (Laird et al), the contents of which are hereby incorporated by reference in their entirety). Briefly, the MethyLight process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed either in an "unbiased" (with primers that do not overlap known CpG methylation sites) PCR reaction, or in a "biased" (with PCR primers that overlap known CpG dinucleotides) reaction. In some cases, sequence discrimination occurs either at the level of the amplification process or at the level of the fluorescence detection process, or both. In some cases, the MethyLight assay is used as a quantitative test for methylation patterns in the genomic DNA sample, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the "MSP" technique), or with oligonucleotides covering potential methylation sites. Typical reagents (e.g., as might be found in a typical MethyLight-based kit) for MethyLight analysis may include, but are not limited to: PCR primers for specific gene (or methylation-altered DNA sequence or CpG island); TaqMan® probes; optimized PCR buffers and deoxynucleotides; and Taq polymerase. The MethyLight technology is used for the commercially available tests for lung cancer (epi proLung BL Reflex Assay); colon cancer (epi proColon assay and mSEPT9 assay) (Epigenomics, Berlin, Germany) PCT Pub. No. WO 2003/064701 (Schweikhardt and Sledziewski), the contents of which is hereby incorporated by reference in its entirety.

Quantitative MethyLight uses bisulfite to convert genomic DNA and the methylated sites are amplified using PCR with methylation independent primers. Detection probes specific for the methylated and unmethylated sites with two different fluorophores provides simultaneous quantitative measurement of the methylation. The Heavy Methyl technique begins with bisulfate conversion of DNA. Next specific blockers prevent the amplification of unmethylated DNA. Methylated genomic DNA does not bind the blockers and their sequences will be amplified. The amplified sequences are detected with a methylation specific probe. (Cottrell et al, 2004, Nuc. Acids Res. 32:e10, the contents of which is hereby incorporated by reference in its entirety).

The Ms-SNuPE technique is a quantitative method for assessing methylation differences at specific CpG sites based on bisulfite treatment of DNA, followed by single-nucleotide primer extension (Gonzalgo and Jones, 1997, Nucleic Acids Res. 25, 2529-2531). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. In some cases, small amounts of DNA are analyzed (e.g., microdissected pathology sections), and the method avoids utilization of restriction enzymes for determining the methylation status at CpG sites. Typical reagents (e.g., as is found in a typical Ms-SNuPE-based kit) for Ms-SNuPE analysis include, but are not limited to: PCR primers for specific gene (or methylation-altered DNA sequence or CpG island); optimized PCR buffers and deoxynucleotides; gel extraction kit; positive control primers; Ms-SNuPE primers for specific gene; reaction buffer (for the Ms-SNuPE reaction); and radioactive nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

In another embodiment, the methylation status of selected CpG sites is determined using differential Binding-based Methylation Detection Methods. For identification of differentially methylated regions, one approach is to capture methylated DNA. This approach uses a protein, in which the methyl binding domain of MBD2 is fused to the Fc fragment of an antibody (MBD-FC) (Gebhard et al, 2006, Cancer Res. 66:6118-6128; and PCT Pub. No. WO 2006/056480 A2 (Relhi), the contents of which are hereby incorporated by reference in their entirety). This fusion protein has several advantages over conventional methylation specific antibodies. The MBD FC has a higher affinity to methylated DNA and it binds double stranded DNA. Most importantly the two proteins differ in the way they bind DNA. Methylation specific antibodies bind DNA stochastically, which means that only a binary answer can be obtained. The methyl binding domain of MBD-FC, on the other hand, binds DNA molecules regardless of their methylation status. The strength of this protein—DNA interaction is defined by the level of DNA methylation. After binding genomic DNA, eluate solutions of increasing salt concentrations can be used to fractionate non-methylated and methylated DNA allowing for a more controlled separation (Gebhard et al, 2006, Nucleic Acids Res. 34: e82). Consequently this method, called Methyl-CpG immunoprecipitation (MCIP), not only enriches, but also fractionates genomic DNA according to methylation level, which is particularly helpful when the unmethylated DNA fraction should be investigated as well.

In an alternative embodiment, a 5-methyl cytidine antibody to bind and precipitate methylated DNA. Antibodies are available from Abcam (Cambridge, Mass.), Diagenode (Sparta, N.J.) or Eurogentec (c/o AnaSpec, Fremont, Calif.). Once the methylated fragments have been separated they may be sequenced using microarray based techniques such as methylated CpG-island recovery assay (MIRA) or methylated DNA immunoprecipitation (MeDIP) (Pelizzola et al, 2008, Genome Res. 18, 1652-1659; O'Geen et al, 2006, BioTechniques 41(5), 577-580, Weber et al, 2005, Nat. Genet. 37, 853-862; Horak and Snyder, 2002, Methods Enzymol, 350, 469-83; Lieb, 2003, Methods Mol Biol, 224, 99-109). Another technique is methyl-CpG binding domain column/segregation of partly melted molecules (MBD/SPM, Shiraishi et al, 1999, Proc. Natl. Acad. Sci. USA 96(6):2913-2918).

In some embodiments, methods for detecting methylation include randomly shearing or randomly fragmenting the genomic DNA, cutting the DNA with a methylation-dependent or methylation-sensitive restriction enzyme and subsequently selectively identifying and/or analyzing the cut or uncut DNA. Selective identification can include, for example, separating cut and uncut DNA (e.g., by size) and quantifying a sequence of interest that was cut or, alternatively, that was not cut. See, e.g., U.S. Pat. No. 7,186,512. Alternatively, the method can encompass amplifying intact DNA after restriction enzyme digestion, thereby only amplifying DNA that was not cleaved by the restriction enzyme in the area amplified. See, e.g., U.S. Pat. No. 7,910,296; U.S. Pat. No. 7,901,880; and U.S. Pat. No. 7,459,274. In some embodiments, amplification can be performed using primers that are gene specific.

For example, there are methyl-sensitive enzymes that preferentially or substantially cleave or digest at their DNA recognition sequence if it is non-methylated. Thus, an unmethylated DNA sample is cut into smaller fragments than a methylated DNA sample. Similarly, a hypermethylated DNA sample is not cleaved. In contrast, there are methyl-sensitive enzymes that cleave at their DNA recognition sequence only if it is methylated. Methyl-sensitive enzymes that digest unmethylated DNA suitable for use in methods of the technology include, but are not limited to, HpaII, HhaI, MaeII, BstUI and AciI. In some instances, an enzyme that is used is HpaII that cuts only the unmethylated sequence CCGG. In other instances, another enzyme that is used is HhaI that cuts only the unmethylated sequence GCGC. Both enzymes are available from New England BioLabs®, Inc. Combinations of two or more methyl-sensitive enzymes that digest only unmethylated DNA are also used. Suitable enzymes that digest only methylated DNA include, but are not limited to, DpnI, which only cuts at fully methylated 5'-GATC sequences, and McrBC, an endonuclease, which cuts DNA containing modified cytosines (5-methylcytosine or 5-hydroxymethylcytosine or N4-methylcytosine) and cuts at recognition site 5' . . . PumC(N4o-3ooo) PumC . . . 3' (New England BioLabs, Inc., Beverly, Mass.). Cleavage methods and procedures for selected restriction enzymes for cutting DNA at specific sites are well known to the skilled artisan. For example, many suppliers of restriction enzymes provide information on conditions and types of DNA sequences cut by specific restriction enzymes, including New England BioLabs, Pro-Mega Biochems, Boehringer-Mannheim, and the like. Sambrook et al. (See Sambrook et al. Molecular Biology: A Laboratory Approach, Cold Spring Harbor, N.Y. 1989) provide a general description of methods for using restriction enzymes and other enzymes.

In some instances, a methylation-dependent restriction enzyme is a restriction enzyme that cleaves or digests DNA at or in proximity to a methylated recognition sequence, but does not cleave DNA at or near the same sequence when the recognition sequence is not methylated. Methylation-dependent restriction enzymes include those that cut at a methylated recognition sequence (e.g., DpnI) and enzymes that cut at a sequence near but not at the recognition sequence (e.g., McrBC). For example, McrBC's recognition sequence is 5' RmC (N40-3000) RmC 3' where "R" is a purine and "mC" is a methylated cytosine and "N40-3000" indicates the distance between the two RmC half sites for which a restriction event has been observed. McrBC generally cuts close to one half-site or the other, but cleavage positions are typically distributed over several base pairs, approximately 30 base pairs from the methylated base. McrBC sometimes cuts 3 of both half sites, sometimes 5' of both half sites, and sometimes between the two sites. Exemplary methylation-dependent restriction enzymes include, e.g., McrBC, McrA, MrrA, BisI, GlaI and DpnI. One of skill in the art will appreciate that any methylation-dependent restriction enzyme, including homologs and orthologs of the restriction enzymes described herein, is also suitable for use in the present invention.

In some cases, a methylation-sensitive restriction enzyme is a restriction enzyme that cleaves DNA at or in proximity to an unmethylated recognition sequence but does not cleave at or in proximity to the same sequence when the recognition sequence is methylated. Exemplary methylation-sensitive restriction enzymes are described in, e.g., McClelland et al, 22(17) NUCLEIC ACIDS RES. 3640-59 (1994). Suitable methylation-sensitive restriction enzymes that do not cleave DNA at or near their recognition sequence when a cytosine within the recognition sequence is methylated at position C5 include, e.g., Aat II, Aci I, Acd I, Age I, Alu I, Asc I, Ase I, AsiS I, Bbe I, BsaA I, BsaH I, BsiE I, BsiW I, BsrF I, BssH II, BssK I, BstB I, BstN I, BstU I, Cla I, Eae I, Eag I, Fau I, Fse I, Hha I, HinPl I, HinC II, Hpa II, Hpy99 I, HpyCH4 IV, Kas I, Mbo I, Mlu I, MapAl I, Msp I, Nae I, Nar I, Not I, Pml I, Pst I, Pvu I, Rsr II, Sac II, Sap I, Sau3A I, Sfl I, Sfo I, SgrA I, Sma I, SnaB I, Tsc I, Xma I, and Zra I. Suitable methylation-sensitive restriction enzymes that do not cleave DNA at or near their recognition sequence when an adenosine within the recognition sequence is methylated at position N6 include, e.g., Mbo I. One of skill in the art will appreciate that any methylation-sensitive restriction enzyme, including homologs and orthologs of the restriction enzymes described herein, is also suitable for use in the present invention. One of skill in the art will further appreciate that a methylation-sensitive restriction enzyme that fails to cut in the presence of methylation of a cytosine at or near its recognition sequence may be insensitive to the presence of methylation of an adenosine at or near its recognition sequence. Likewise, a methylation-sensitive restriction enzyme that fails to cut in the presence of methylation of an adenosine at or near its recognition sequence may be insensitive to the presence of methylation of a cytosine at or near its recognition sequence. For example, Sau3AI is sensitive (i.e., fails to cut) to the presence of a methylated cytosine at or near its recognition sequence, but is insensitive (i.e., cuts) to the presence of a methylated adenosine at or near its recognition sequence. One of skill in the art will also appreciate that some methylation-sensitive restriction enzymes are blocked by methylation of bases on one or both strands of DNA encompassing of their recognition sequence, while other methylation-sensitive restriction enzymes are blocked only by methylation on both strands, but can cut if a recognition site is hemi-methylated.

In alternative embodiments, adaptors are optionally added to the ends of the randomly fragmented DNA, the DNA is then digested with a methylation-dependent or methylation-sensitive restriction enzyme, and intact DNA is subsequently amplified using primers that hybridize to the adaptor sequences. In this case, a second step is performed to determine the presence, absence or quantity of a particular gene in an amplified pool of DNA. In some embodiments, the DNA is amplified using real-time, quantitative PCR.

In other embodiments, the methods comprise quantifying the average methylation density in a target sequence within a population of genomic DNA. In some embodiments, the method comprises contacting genomic DNA with a methylation-dependent restriction enzyme or methylation-sensitive restriction enzyme under conditions that allow for at least some copies of potential restriction enzyme cleavage sites in the locus to remain uncleaved; quantifying intact copies of the locus; and comparing the quantity of amplified product to a control value representing the quantity of methylation of control DNA, thereby quantifying the average methylation density in the locus compared to the methylation density of the control DNA.

In some instances, the quantity of methylation of a locus of DNA is determined by providing a sample of genomic DNA comprising the locus, cleaving the DNA with a restriction enzyme that is either methylation-sensitive or methylation-dependent, and then quantifying the amount of intact DNA or quantifying the amount of cut DNA at the DNA locus of interest. The amount of intact or cut DNA will depend on the initial amount of genomic DNA containing the locus, the amount of methylation in the locus, and the number (i.e., the fraction) of nucleotides in the locus that are methylated in the genomic DNA. The amount of methylation in a DNA locus can be determined by comparing the quantity of intact DNA or cut DNA to a control value representing the quantity of intact DNA or cut DNA in a similarly-treated DNA sample. The control value can represent a known or predicted number of methylated nucleotides. Alternatively, the control value can represent the quantity of intact or cut DNA from the same locus in another (e.g., normal, non-diseased) cell or a second locus.

By using at least one methylation-sensitive or methylation-dependent restriction enzyme under conditions that allow for at least some copies of potential restriction enzyme cleavage sites in the locus to remain uncleaved and subsequently quantifying the remaining intact copies and comparing the quantity to a control, average methylation density of a locus can be determined. If the methylation-sensitive restriction enzyme is contacted to copies of a DNA locus under conditions that allow for at least some copies of potential restriction enzyme cleavage sites in the locus to remain uncleaved, then the remaining intact DNA will be directly proportional to the methylation density, and thus may be compared to a control to determine the relative methylation density of the locus in the sample. Similarly, if a methylation-dependent restriction enzyme is contacted to copies of a DNA locus under conditions that allow for at least some copies of potential restriction enzyme cleavage sites in the locus to remain uncleaved, then the remaining intact DNA will be inversely proportional to the methylation density, and thus may be compared to a control to determine the relative methylation density of the locus in the sample. Such assays are disclosed in, e.g., U.S. Pat. No. 7,910,296.

The methylated CpG island amplification (MCA) technique is a method that can be used to screen for altered methylation patterns in genomic DNA, and to isolate specific sequences associated with these changes (Toyota et al, 1999, Cancer Res. 59, 2307-2312, U.S. Pat. No. 7,700,324 (Issa et al), the contents of which are hereby incorporated by reference in their entirety). Briefly, restriction enzymes with different sensitivities to cytosine methylation in their recognition sites are used to digest genomic DNAs from primary tumors, cell lines, and normal tissues prior to arbitrarily primed PCR amplification. Fragments that show differential methylation are cloned and sequenced after resolving the PCR products on high-resolution polyacrylamide gels. The cloned fragments are then used as probes for Southern analysis to confirm differential methylation of these regions. Typical reagents (e.g., as might be found in a typical MCA-based kit) for MCA analysis may include, but are not limited to: PCR primers for arbitrary priming Genomic DNA; PCR buffers and nucleotides, restriction enzymes and appropriate buffers; gene-hybridization oligos or probes; control hybridization oligos or probes.

Additional methylation detection methods include those methods described in, e.g., U.S. Pat. No. 7,553,627; U.S. Pat. No. 6,331,393; U.S. patent Ser. No. 12/476,981; U.S. Patent Publication No. 2005/0069879; Rein, et al, 26(10) NUCLEIC ACIDS RES. 2255-64 (1998); and Olek et al, 17(3) NAT. GENET. 275-6 (1997).

In another embodiment, the methylation status of selected CpG sites is determined using Methylation-Sensitive High Resolution Melting (FIRM). Recently, Wojdacz et al. reported methylation-sensitive high resolution melting as a technique to assess methylation. (Wojdacz and Dobrovic, 2007, Nuc. Acids Res. 35(6) e41; Wojdacz et al. 2008, Nat. Prot. 3(12) 1903-1908; Balic et al, 2009 J. Mol. Diagn. 11 102-108; and US Pat. Pub. No. 2009/0155791 (Wojdacz et al), the contents of which are hereby incorporated by reference in their entirety). A variety of commercially available real time PCR machines have HRM systems including the Roche LightCycler480, Corbett Research RotorGene6000, and the Applied Biosystems 7500. HRM may also be combined with other amplification techniques such as pyrosequencing as described by Candiloro et al. (Candiloro et al, 2011, Epigenetics 6(4) 500-507).

In another embodiment, the methylation status of selected CpG locus is determined using a primer extension assay, including an optimized PCR amplification reaction that produces amplified targets for analysis using mass spectrometry. The assay can also be done in multiplex. Mass spectrometry is a particularly effective method for the detection of polynucleotides associated with the differentially methylated regulatory elements. The presence of the polynucleotide sequence is verified by comparing the mass of the detected signal with the expected mass of the polynucleotide of interest. The relative signal strength, e.g., mass peak on a spectra, for a particular polynucleotide sequence indicates the relative population of a specific allele, thus enabling calculation of the allele ratio directly from the data. This method is described in detail in PCT Pub. No. WO 2005/012578A1 (Beaulieu et al), which is hereby incorporated by reference in its entirety. For methylation analysis, the assay can be adopted to detect bisulfite introduced methylation dependent C to T sequence changes. These methods are particularly useful for performing multiplexed amplification reactions and multiplexed primer extension reactions (e.g., multiplexed homogeneous primer mass extension (hME) assays) in a single well to further increase the throughput and reduce the cost per reaction for primer extension reactions.

Other methods for DNA methylation analysis include restriction landmark genomic scanning (RLGS, Costello et al, 2002, Meth. Mol Biol, 200, 53-70), methylation-sensitive-representational difference analysis (MS-RDA, Ushijima and Yamashita, 2009, Methods Mol Biol 507, 117-130). Comprehensive high-throughput arrays for relative methylation (CHARM) techniques are described in WO 2009/021141 (Feinberg and Irizarry). The Roche® NimbleGen® microarrays including the Chromatin Immunoprecipitation-on-chip (ChIP-chip) or methylated DNA immunoprecipitation-on-chip (MeDIP-chip). These tools have been used for a variety of cancer applications including melanoma, liver cancer and lung cancer (Koga et al, 2009, Genome Res., 19, 1462-1470; Acevedo et al, 2008, Cancer Res., 68, 2641-2651; Rauch et al, 2008, Proc. Nat. Acad. Sci. USA, 105, 252-257). Others have reported bisulfate conversion, padlock probe hybridization, circularization, amplification and next generation or multiplexed sequencing for high throughput detection of methylation (Deng et al, 2009, Nat. Biotechnol 27, 353-360; Ball et al, 2009, Nat. Biotechnol 27, 361-368; U.S. Pat. No. 7,611,869 (Fan)). As an alternative to bisulfate oxidation, Bayeyt et al. have reported selective oxidants that oxidize 5-methylcytosine, without reacting with thymidine, which are followed by PCR or pyro sequencing (WO 2009/049916 (Bayeyt et al). These references for these techniques are hereby incorporated by reference in their entirety.

In some instances, quantitative amplification methods (e.g., quantitative PCR or quantitative linear amplification) are used to quantify the amount of intact DNA within a locus flanked by amplification primers following restriction digestion. Methods of quantitative amplification are disclosed in, e.g., U.S. Pat. No. 6,180,349; U.S. Pat. No. 6,033,854; and U.S. Pat. No. 5,972,602, as well as in, e.g., DeGraves, et al, 34(1) BIOTECHNIQUES 106-15 (2003); Deiman B, et al., 20(2) MOL. BIOTECHNOL. 163-79 (2002); and Gibson et al, 6 GENOME RESEARCH 995-1001 (1996).

Following reaction or separation of nucleic acid in a methylation specific manner, the nucleic acid in some cases are subjected to sequence-based analysis. For example, once it is determined that one particular melanoma genomic sequence is hypermethylated or hypomethylated compared to the benign counterpart, the amount of this genomic sequence can be determined. Subsequently, this amount can be compared to a standard control value and serve as an indication for the melanoma. In many instances, it is desirable to amplify a nucleic acid sequence using any of several nucleic acid amplification procedures which are well known in the art. Specifically, nucleic acid amplification is the chemical or enzymatic synthesis of nucleic acid copies which contain a sequence that is complementary to a nucleic acid sequence being amplified (template). The methods and kits of the invention may use any nucleic acid amplification or detection methods known to one skilled in the art, such as those described in U.S. Pat. No. 5,525,462 (Takarada et al); U.S. Pat. No. 6,114,117 (Hepp et al); U.S. Pat. No. 6,127,120 (Graham et al); U.S. Pat. No. 6,344,317 (Urnovitz); U.S. Pat. No. 6,448,001 (Oku); U.S. Pat. No. 6,528,632 (Catanzariti et al); and PCT Pub. No. WO 2005/111209 (Nakajima et al); all of which are incorporated herein by reference in their entirety.

In some embodiments, the nucleic acids are amplified by PCR amplification using methodologies known to one skilled in the art. One skilled in the art will recognize, however, that amplification can be accomplished by any known method, such as ligase chain reaction (LCR), Q-replicas amplification, rolling circle amplification, transcription amplification, self-sustained sequence replication, nucleic acid sequence-based amplification (NASBA), each of which provides sufficient amplification. Branched-DNA technology is also optionally used to qualitatively demonstrate the presence of a sequence of the technology, which represents a particular methylation pattern, or to quantitatively determine the amount of this particular genomic sequence in a sample. Nolte reviews branched-DNA signal amplification for direct quantitation of nucleic acid sequences in clinical samples (Nolte, 1998, Adv. Clin. Chem. 33:201-235).

The PCR process is well known in the art and include, for example, reverse transcription PCR, ligation mediated PCR, digital PCR (dPCR), or droplet digital PCR (ddPCR). For a review of PCR methods and protocols, see, e.g., Innis et al, eds., PCR Protocols, A Guide to Methods and Application, Academic Press, Inc., San Diego, Calif. 1990; U.S. Pat. No. 4,683,202 (Mullis). PCR reagents and protocols are also available from commercial vendors, such as Roche Molecular Systems. In some instances, PCR is carried out as an automated process with a thermostable enzyme. In this process, the temperature of the reaction mixture is cycled through a denaturing region, a primer annealing region, and an extension reaction region automatically. Machines specifically adapted for this purpose are commercially available.

In some embodiments, amplified sequences are also measured using invasive cleavage reactions such as the Invader® technology (Zou et al, 2010, Association of Clinical Chemistry (AACC) poster presentation on Jul. 28, 2010, "Sensitive Quantification of Methylated Markers with a Novel Methylation Specific Technology; and U.S. Pat. No. 7,011,944 (Prudent et al)).

Suitable next generation sequencing technologies are widely available. Examples include the 454 Life Sciences platform (Roche, Branford, Conn.) (Margulies et al. 2005 Nature, 437, 376-380); Illumina's Genome Analyzer, GoldenGate Methylation Assay, or Infinium Methylation Assays, i.e., Infinium HumanMethylation 27K BeadArray or VeraCode GoldenGate methylation array (Illumina, San Diego, Calif.; Bibkova et al, 2006, Genome Res. 16, 383-393; U.S. Pat. Nos. 6,306,597 and 7,598,035 (Macevicz); U.S. Pat. No. 7,232,656 (Balasubramanian et al.)); QX200™ Droplet Digital™ PCR System from Bio-Rad; or DNA Sequencing by Ligation, SOLiD System (Applied Biosystems/Life Technologies; U.S. Pat. Nos. 6,797,470, 7,083,917, 7,166,434, 7,320,865, 7,332,285, 7,364,858, and 7,429,453 (Barany et al); the Helicos True Single Molecule DNA sequencing technology (Harris et al, 2008 Science, 320, 106-109; U.S. Pat. Nos. 7,037,687 and 7,645,596 (Williams et al); U.S. Pat. No. 7,169,560 (Lapidus et al); U.S. Pat. No. 7,769,400 (Harris)), the single molecule, real-time (SMRT™) technology of Pacific Biosciences, and sequencing (Soni and Meller, 2007, Clin. Chem. 53, 1996-2001); semiconductor sequencing (Ion Torrent; Personal Genome Machine); DNA nanoball sequencing; sequencing using technology from Dover Systems (Polonator), and technologies that do not require amplification or otherwise transform native DNA prior to sequencing (e.g., Pacific Biosciences and Helicos), such as nanopore-based strategies (e.g., Oxford Nanopore, Genia Technologies, and Nabsys). These systems allow the sequencing of many nucleic acid molecules isolated from a specimen at high orders of multiplexing in a parallel fashion. Each of these platforms allow sequencing of clonally expanded or non-amplified single molecules of nucleic acid fragments. Certain platforms involve, for example, (i) sequencing by ligation of dye-modified probes (including cyclic ligation and cleavage), (ii) pyrosequencing, and (iii) single-molecule sequencing.

Pyrosequencing is a nucleic acid sequencing method based on sequencing by synthesis, which relies on detection of a pyrophosphate released on nucleotide incorporation. Generally, sequencing by synthesis involves synthesizing, one nucleotide at a time, a DNA strand complimentary to the strand whose sequence is being sought. Study nucleic acids may be immobilized to a solid support, hybridized with a sequencing primer, incubated with DNA polymerase, ATP sulfurylase, luciferase, apyrase, adenosine 5' phosphsulfate and luciferin. Nucleotide solutions are sequentially added and removed. Correct incorporation of a nucleotide releases a pyrophosphate, which interacts with ATP sulfurylase and produces ATP in the presence of adenosine 5' phosphsulfate, fueling the luciferin reaction, which produces a chemiluminescent signal allowing sequence determination. Machines for pyrosequencing and methylation specific reagents are available from Qiagen, Inc. (Valencia, Calif.). See also Tost and Gut, 2007, Nat. Prot. 2 2265-2275. An example of a system that can be used by a person of ordinary skill based on pyrosequencing generally involves the following steps: ligating an adaptor nucleic acid to a study nucleic acid and hybridizing the study nucleic acid to a bead; amplifying a nucleotide sequence in the study nucleic acid in an emulsion; sorting beads using a picoliter multiwell solid support; and sequencing amplified nucleotide sequences by pyrosequencing methodology (e.g., Nakano et al, 2003, J. Biotech. 102, 117-124). Such a system can be used to exponentially amplify amplification products generated by a process described herein, e.g., by ligating a heterologous nucleic acid to the first amplification product generated by a process described herein.

Probes

In some instances, one or more probes of a probe panel are used in a sequencing method described above. In some instances, one or more probes of a probe panel comprising a probe of Formula I:

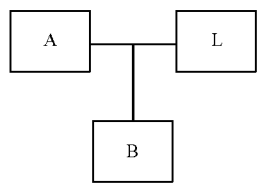

Formula I wherein:
A is a first target-binding region;
B is a second target-binding region; and
L is a linker region;
wherein A comprises at least 70%, 80%, 90%, 95%, or 99% sequence identity to at least 30 contiguous nucleotides starting at position 1 from the 5' terminus of a sequence selected from SEQ ID NOs: 1-1775; B comprises at least 70%, 80%, 90%, 95%, or 99% sequence identity to at least 12 contiguous nucleotides starting at position 1' from the 3' terminus of the same sequence selected from SEQ ID NOs: 1-1775; L is attached to A; and B is attached to either A or L.

In some instances, L is attached to A and B is attached to L. In some cases, A, B, and L are attached as illustrated in Formula Ia:

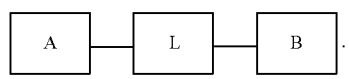

Formula Ia

In some cases, the plurality of probes comprises at least 10, 20, 30, 50, 100, 200, 500, 1000, 1500, 1775, 1800, 2000, or more probes. In some cases, the plurality of probers comprises 10, 20, 30, 50, 100, or more probes.

In some embodiments, A comprises at least 70%, 80%, 90%, 95%, or 99% sequence identity to at least 35 contiguous nucleotides starting at position 1 from the 5' terminus of a sequence selected from SEQ ID NOs: 1-1775. In some cases, A comprises at least 70%, 80%, 90%, 95%, or 99% sequence identity to at least 40 contiguous nucleotides starting at position 1 from the 5' terminus of a sequence selected from SEQ ID NOs: 1-1775. In some cases, A comprises at least 70%, 80%, 90%, 95%, or 99% sequence identity to at least 45 contiguous nucleotides starting at position 1 from the 5' terminus of a sequence selected from SEQ ID NOs: 1-1775. In some cases, A comprises at least 70%, 80%, 90%, 95%, or 99% sequence identity to at least 50 contiguous nucleotides starting at position 1 from the 5' terminus of a sequence selected from SEQ ID NOs: 1-1775. In some cases, A comprises at least 70%, 80%, 90%, 95%, or 99% sequence identity to at least 55 contiguous nucleotides starting at position 1 from the 5' terminus of a sequence selected from SEQ ID NOs: 1-1775. In some cases, A comprises at least 70%, 80%, 90%, 95%, or 99% sequence identity to at least 60 contiguous nucleotides starting at position 1 from the 5' terminus of a sequence selected from SEQ ID NOs: 1-1775. In some cases, A comprises at least 70%, 80%, 90%, 95%, or 99% sequence identity to at least 65 contiguous nucleotides starting at position 1 from the 5' terminus of a sequence selected from SEQ ID NOs: 1-1775. In some cases, A comprises at least 70%, 80%, 90%, 95%, or 99% sequence identity to at least 70 contiguous nucleotides starting at position 1 from the 5' terminus of a sequence selected from SEQ ID NOs: 1-1775. In some cases, A comprises at least 70%, 80%, 90%, 95%, or 99% sequence identity to at least 80 contiguous nucleotides starting at position 1 from the 5' terminus of a sequence selected from SEQ ID NOs: 1-1775. In some cases, A comprises at least 70%, 80%, 90%, 95%, or 99% sequence identity to at least 90 contiguous nucleotides starting at position 1 from the 5' terminus of a sequence selected from SEQ ID NOs: 1-1775.

In some embodiments, B comprises at least 70%, 80%, 90%, 95%, or 99% sequence identity to at least 14 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 15 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 18 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 20 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 22 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 25 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 28 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 30 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 35 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 40 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 45 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 50 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 55 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 60 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 65 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 70 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 80 contiguous nucleotides starting at position 1' from the 3' terminus of the same sequence selected from SEQ ID NOs: 1-1775. In some cases, B comprises at least 70%, 80%, 90%, 95%, or 99% sequence identity to at least 90 contiguous nucleotides starting at position 1' from the 3' terminus of the same sequence selected from SEQ ID NOs: 1-1775.

In some instances, the plurality of probes is used in a next generation sequencing reaction to generate a CpG methylation data. In some instances, the plurality of probes is used in a solution-based next generation sequencing reaction to generate a CpG methylation data. In some instances, the next generation sequencing reaction comprises 454 Life Sciences platform (Roche, Branford, Conn.); Illumina's Genome Analyzer, GoldenGate Methylation Assay, or Infinium Methylation Assays, i.e., Infinium HumanMethylation 27K BeadArray or VeraCode GoldenGate methylation array (Illumina, San Diego, Calif.); QX200™ Droplet Digital™ PCR System from Bio-Rad; DNA Sequencing by Ligation, SOLiD System (Applied Biosystems/Life Technologies); the Helicos True Single Molecule DNA sequencing technology; semiconductor sequencing (Ion Torrent; Personal Genome Machine); DNA nanoball sequencing; sequencing using technology from Dover Systems (Polonator), and technologies that do not require amplification or otherwise transform native DNA prior to sequencing (e.g., Pacific Biosciences and Helicos), such as nanopore-based strategies (e.g., Oxford Nanopore, Genia Technologies, and Nabsys). In some instances, the solution-based next generation sequencing reaction is a droplet digital PCR sequencing method.

In some instances, each probe correlates to a CpG site. In some instances, each probe correlates to a biomarker (e.g., CpG site) selected from Tables 1-42. In some instances, each probe correlates to a biomarker selected from Tables 8-41. In some instances, each probe correlates to a biomarker selected from Tables 60-61.

In some instances, L is between 10 and 60, 15 and 55, 20 and 50, 25 and 45, and 30 and 40 nucleotides in length. In some instances, L is about 15, 20, 25, 30, 35, 40, 45, 50, 55, or 60 nucleotides in length.

In some instances, L further comprises an adaptor region. In some instances, the adaptor region comprises a sequence used to identify each probe.

In some embodiments, one or more probes of a probe panel comprise a sequence that is at least 50%, 60%, 70%, 80%, 90%, 95%, 98%, or 99% sequence identity to a sequence selected from SEQ ID NOs: 1830-2321. In some instances, one or more probes of a probe panel comprise a sequence that is about 100% sequence identity to a sequence selected from SEQ ID NOs: 1830-2321. In some instances, one or more probes of a probe panel consist of a sequence selected from SEQ ID NOs: 1830-2321. In some cases, the one or more probes of a probe panel are utilized in a digital PCR sequencing method. In some cases, the one or more probes of a probe panel are utilized in a droplet digital PCR (ddPCR) sequencing method.

CpG Methylation Data Analysis Methods

In certain embodiments, the methylation values measured for markers of a biomarker panel are mathematically combined and the combined value is correlated to the underlying diagnostic question. In some instances, methylated biomarker values are combined by any appropriate state of the art mathematical method. Well-known mathematical methods for correlating a marker combination to a disease status employ methods like discriminant analysis (DA) (e.g., linear-, quadratic-, regularized-DA), Discriminant Functional Analysis (DFA), Kernel Methods (e.g., SVM), Multidimensional Scaling (MDS), Nonparametric Methods (e.g., k-Nearest-Neighbor Classifiers), PLS (Partial Least Squares), Tree-Based Methods (e.g., Logic Regression, CART, Random Forest Methods, Boosting/Bagging Methods), Generalized Linear Models (e.g., Logistic Regression), Principal Components based Methods (e.g., SIMCA), Generalized Additive Models, Fuzzy Logic based Methods, Neural Networks and Genetic Algorithms based Methods. The skilled artisan will have no problem in selecting an appropriate method to evaluate a biomarker combination of the present invention. In one embodiment, the method used in a correlating methylation status of a biomarker combination of the present invention, e.g. to diagnose CRC, is selected from DA (e.g., Linear-, Quadratic-, Regularized Discriminant Analysis), DFA, Kernel Methods (e.g., SVM), MDS, Nonparametric Methods (e.g., k-Nearest-Neighbor Classifiers), PLS (Partial Least Squares), Tree-Based Methods (e.g., Logic Regression, CART, Random Forest Methods, Boosting Methods), or Generalized Linear Models (e.g., Logistic Regression), and Principal Components Analysis. Details relating to these statistical methods are found in the following references: Ruczinski et al., 12 J. OF COMPUTATIONAL AND GRAPHICAL STATISTICS 475-511 (2003); Friedman, J. H., 84 J. OF THE AMERICAN STATISTICAL ASSOCIATION 165-75 (1989); Hastie, Trevor, Tibshirani, Robert, Friedman, Jerome, The Elements of Statistical Learning, Springer Series in Statistics (2001); Breiman, L., Friedman, J. H., Olshen, R. A., Stone, C. J. Classification and regression trees, California: Wadsworth (1984); Breiman, L., 45 MACHINE LEARNING 5-32 (2001); Pepe, M. S., The Statistical Evaluation of Medical Tests for Classification and Prediction, Oxford Statistical Science Series, 28 (2003); and Duda, R. O., Hart, P. E., Stork, D. O., Pattern Classification, Wiley Interscience, 2nd Edition (2001).

In one embodiment, the correlated results for each methylation panel are rated by their correlation to the disease or tumor type positive state, such as for example, by p-value test or t-value test or F-test. Rated (best first, i.e. low p- or t-value) markers are then subsequently selected and added to the methylation panel until a certain diagnostic value is reached. Such methods include identification of methylation panels, or more broadly, genes that were differentially methylated among several classes using, for example, a random-variance t-test (Wright G. W. and Simon R, Bioinformatics 19:2448-2455, 2003). Other methods include the step of specifying a significance level to be used for determining the biomarkers that will be included in the biomarker panel. Biomarkers that are differentially methylated between the classes at a univariate parametric significance level less than the specified threshold are included in the panel. It doesn't matter whether the specified significance level is small enough to exclude enough false discoveries. In some problems better prediction is achieved by being more liberal about the biomarker panels used as features. In some cases, the panels are biologically interpretable and clinically applicable, however, if fewer biomarkers are included. Similar to cross-validation, biomarker selection is repeated for each training set created in the cross-validation process. That is for the purpose of providing an unbiased estimate of prediction error. The methylation panel for use with new patient sample data is the one resulting from application of the methylation selection and classifier of the "known" methylation information, or control methylation panel.

Models for utilizing methylation profile to predict the class of future samples can also be used. These models may be based on the Compound Covariate Predictor (Radmacher et al. Journal of Computational Biology 9:505-511, 2002), Diagonal Linear Discriminant Analysis (Dudoit et al. Journal of the American Statistical Association 97:77-87, 2002), Nearest Neighbor Classification (also Dudoit et al.), and Support Vector Machines with linear kernel (Ramaswamy et al. PNAS USA 98:15149-54, 2001). The models incorporated biomarkers that were differentially methylated at a given significance level (e.g. 0.01, 0.05 or 0.1) as assessed by the random variance t-test (Wright G. W. and Simon R. Bioinformatics 19:2448-2455, 2003). The prediction error of each model using cross validation, preferably leave-one-out cross-validation (Simon et al. Journal of the National Cancer Institute 95:14-18, 2003 can be estimated. For each leave-one-out cross-validation training set, the entire model building process is repeated, including the biomarker selection process. It may also be evaluated whether the cross-validated error rate estimate for a model is significantly less than one would expect from random prediction. The class labels can be randomly permuted and the entire leave-one-out cross-validation process is then repeated. The significance level is the proportion of the random permutations that gives a cross-validated error rate no greater than the cross-validated error rate obtained with the real methylation data.

Another classification method is the greedy-pairs method described by Bo and Jonassen (Genome Biology 3(4): research0017.1-0017.11, 2002). The greedy-pairs approach starts with ranking all biomarkers based on their individual t-scores on the training set. This method attempts to select pairs of biomarkers that work well together to discriminate the classes.

Furthermore, a binary tree classifier for utilizing methylation profile can be used to predict the class of future samples. The first node of the tree incorporated a binary classifier that distinguished two subsets of the total set of classes. The individual binary classifiers are based on the "Support Vector Machines" incorporating biomarkers that were differentially expressed among biomarkers at the significance level (e.g. 0.01, 0.05 or 0.1) as assessed by the random variance t-test (Wright G. W. and Simon R. Bioinformatics 19:2448-2455, 2003). Classifiers for all possible binary partitions are evaluated and the partition selected is that for which the cross-validated prediction error is minimum. The process is then repeated successively for the two subsets of classes determined by the previous binary split. The prediction error of the binary tree classifier can be estimated by cross-validating the entire tree building process. This overall cross-validation includes re-selection of the optimal partitions at each node and re-selection of the biomarkers used for each cross-validated training set as described by Simon et al. (Simon et al. Journal of the National Cancer Institute 95:14-18, 2003). Several-fold cross validation in which a fraction of the samples is withheld, a binary tree developed on the remaining samples, and then class membership is predicted for the samples withheld. This is repeated several times, each time withholding a different percentage of the samples. The samples are randomly partitioned into fractional test sets (Simon R and Lam A. BRB-ArrayTools User Guide, version 3.2. Biometric Research Branch, National Cancer Institute).

Thus, in one embodiment, the correlated results for each biomarker b) are rated by their correct correlation to the disease or tumor type positive state, preferably by p-value test. It is also possible to include a step in that the biomarkers are selected d) in order of their rating.

In additional embodiments, factors such as the value, level, feature, characteristic, property, etc. of a transcription rate, mRNA level, translation rate, protein level, biological activity, cellular characteristic or property, genotype, phenotype, etc. can be utilized in addition prior to, during, or after administering a therapy to a patient to enable further analysis of the patient's cancer status.

Specificity and Sensitivity

The power of a diagnostic test to correctly predict status is commonly measured as the sensitivity of the assay, the specificity of the assay or the area under a receiver operated characteristic ("ROC") curve. Sensitivity is the percentage of true positives that are predicted by a test to be positive, while specificity is the percentage of true negatives that are predicted by a test to be negative. An ROC curve provides the sensitivity of a test as a function of 1-specificity. The greater the area under the ROC curve, the more powerful the predictive value of the test. Other useful measures of the utility of a test are positive predictive value and negative predictive value. Positive predictive value is the percentage of people who test positive that are actually positive. Negative predictive value is the percentage of people who test negative that are actually negative.

In particular embodiments, the biomarker panels of the present invention may show a statistical difference in different cancer statuses of at least $p<0.05$, $p<10^{-2}$, $p<10^{-3}$, $p<10^{-4}$ or $p<10^{-5}$. Diagnostic tests that use these biomarkers may show an ROC of at least 0.6, at least about 0.7, at least about 0.8, or at least about 0.9. The biomarkers are differentially methylated in unaffected individual (or a normal control individual) and cancer, and the biomarkers for each cancer type are differentially methylated, and, therefore, are useful in aiding in the determination of cancer status. In certain embodiments, the biomarkers are measured in a patient sample using the methods described herein and compared, for example, to predefined biomarker levels and correlated to cancer status. In other embodiments, the correlation of a combination of biomarkers in a patient sample is compared, for example, to a predefined biomarker panel. In yet another embodiment, the methylation profile of one or more genes in a patient sample are compared to the methylation profile of genes identified differentially methylated correlated to a tumor type or state or cancer status. In particular embodiments, the measurement(s) may then be compared with a relevant diagnostic amount(s), cut-off(s), or multivariate model scores that distinguish a positive cancer status from a negative cancer status. The diagnostic amount(s) represents a measured amount of epigenetic biomarker(s) above which or below which a patient is classified as having a particular cancer status. As is well understood in the art, by adjusting the particular diagnostic cut-off(s) used in an assay, one can increase sensitivity or specificity of the diagnostic assay depending on the preference of the diagnostician. In particular embodiments, the particular diagnostic cut-off can be determined, for example, by measuring the amount of biomarker hypermethylation or hypomethylation in a statistically significant number of samples from patients with the different cancer statuses, and drawing the cut-off to suit the desired levels of specificity and sensitivity.

Cancer

In some embodiments, disclosed herein include the use of one or more biomarkers described supra to detect, characterize and/or predict cancer. In some instances, the biomarkers are used in diagnostic tests to determine, characterize, qualify, and/or assess a cancer. In some cases, the biomarkers include those shown in Tables 1-42. In some instances, the biomarkers include those shown in Tables 60 and 61.

In some instances, the cancer is a solid tumor or a hematologic malignancy. In some instances, the cancer is a carcinoma, a sarcoma, a lymphoma, or a leukemia. In some instances, the cancer is a naive cancer, or a cancer that has not been treated by a particular therapeutic agent. In some instances, the cancer is a primary tumor or a primary cancer, a tumor that originated in the location or organ in which it is present and did not metastasize to that location from another location. In some instances, the cancer is a metastatic cancer. In some cases, the cancer is a relapsed or refractory cancer.

In some instances, a tumor or cancer originates from blood, lymph node, liver, brain/neuroblastoma, esophagus, trachea, stomach, intestine, colon, rectum, anus, pancreas, throat, tongue, bone, ovary, uterus, cervix, peritoneum, prostate, testes, breast, kidney, lung, or skin, gastric, colorectal, bladder, head and neck, nasopharyngeal, endometrial, bile duct, oral, multiple myeloma, leukemia, soft tissue sarcoma, gall bladder, endocrine, mesothelioma, wilms tumor, duodenum, neuroendocrine, salivary gland, larynx, choriocarcinoma, cardial, small bowel, eye, germ cell cancer, and the like.

In some instances, a tumor or cancer includes, but is not limited to, acute lymphoblastic leukemia (ALL); acute myeloid leukemia (LAML or AML); adrenocortical carcinoma (ACC); AIDS-related cancers; AIDS-related lymphoma; anal cancer; appendix cancer; astrocytomas; atypical teratoid/rhabdoid tumor; basal cell carcinoma; bladder or bladder urothelial cancer (BLCA); brain stem glioma; brain lower grade glioma (LGG); brain tumor (including brain stem glioma, central nervous system atypical teratoid/rhabdoid tumor, central nervous system embryonal tumors, astrocytomas, craniopharyngioma, ependymoblastoma, ependymoma, meduUoblastoma, medulloepithelioma, pineal parenchymal tumors of intermediate differentiation, supratentorial primitive neuroectodermal tumors and pineoblastoma); breast or brain invasive cancer (BRCA); bronchial tumors; Burkitt lymphoma; cancer of unknown primary site; carcinoid tumor; carcinoma of unknown primary site; central nervous system atypical teratoid/rhabdoid tumor; central nervous system embryonal tumors; including cervical squamous cell carcinoma and endocervical adenocarcinoma (CESC) cancer; childhood cancers; cholangiocarcinoma (CHOL); chordoma; chronic lymphocytic leukemia; chronic myelogenous leukemia; chronic myeloproliferative disorders; colon (adenocarcinoma) cancer (COAD); colorectal cancer; craniopharyngioma; cutaneous T-cell lymphoma; endocrine pancreas islet cell tumors; endometrial cancer; ependymoblastoma; ependymoma; esophageal cancer ESCA); esthesioneuroblastoma; Ewing sarcoma; extracranial germ cell tumor; extragonadal germ cell tumor; extrahepatic bile duct cancer; gallbladder cancer; gastric (stomach) cancer; gastrointestinal carcinoid tumor; gastrointestinal stromal cell tumor; gastrointestinal stromal tumor (GIST); gestational trophoblastic tumor; glioblstoma multiforme glioma GBM); hairy cell leukemia; head and neck cancer (HNSD); heart cancer; Hodgkin lymphoma; hypopharyngeal cancer; intraocular melanoma; islet cell tumors; Kaposi sarcoma; kidney cancer including kidney chromophobe (KIHC) kidney renal clear cell carcinoma (KIRC and kidney renal papillary cell carcinoma (KIRP); Langerhans cell histiocytosis; laryngeal cancer; lip cancer; liver cancer including liver hepatocellular carcinoma (LIHC), lung adenocarcinoma (LUAD) and lung squamous cell carcinoma (LUSC); Lymphoid Neoplasm Diffuse Large B-cell Lymphoma [DLBC]; malignant fibrous histiocytoma bone cancer; medulloblastoma; medullo epithelioma; melanoma; Merkel cell carcinoma; Merkel cell skin carcinoma; mesothelioma (MESO); metastatic squamous neck cancer with occult primary; mouth cancer; multiple endocrine neoplasia syndromes; multiple myeloma; multiple myeloma/plasma cell neoplasm; mycosis fungoides; myelodysplastic syndromes; myeloproliferative neoplasms; nasal cavity cancer; nasopharyngeal cancer; neuroblastoma; Non-Hodgkin lymphoma; nonmelanoma skin cancer; non-small cell lung cancer; oral cancer; oral cavity cancer; oropharyngeal cancer; osteosarcoma; other brain and spinal cord tumors; ovarian cancer such as Ovarian serous cystadenocarcinoma (OV); ovarian epithelial cancer; ovarian germ cell tumor; ovarian low malignant potential tumor; pancreatic cancer such as Pancreatic adenocarcinoma (PAAD); papillomatosis; paranasal sinus cancer; parathyroid cancer; pelvic cancer; penile cancer; pharyngeal cancer; pheochromocytoma and paraganglioma (PCPG); pineal parenchymal tumors of intermediate differentiation; pineoblastoma; pituitary tumor; plasma cell neoplasm/multiple myeloma; pleuropulmonary blastoma; primary central nervous system (CNS) lymphoma; primary hepatocellular liver cancer; prostate cancer such as prostate adenocarcinoma (PRAD); rectal cancer such as rectum adenocarcinoma (READ); renal cancer; renal cell (kidney) cancer; renal cell cancer; respiratory tract cancer; retinoblastoma; rhabdomyosarcoma; salivary gland cancer; sarcoma (SARC); Sezary syndrome; skin cutaneous melanoma (SKCM); small cell lung cancer; small intestine cancer; soft tissue sarcoma; squamous cell carcinoma; squamous neck cancer; stomach (gastric) cancer such as stomach adenocarcinoma (STAD);

supratentorial primitive neuroectodermal tumors; T-cell lymphoma; testicular cancer testicular germ cell tumors (TGCT); throat cancer; thymic carcinoma; thymoma (THYM); thyroid cancer (THCA); transitional cell cancer; transitional cell cancer of the renal pelvis and ureter; trophoblastic tumor; ureter cancer; urethral cancer; uterine cancer; uterine cancer such as uterine carcinosarcoma (UCS) and uterine corpus endometrial carcinoma (UCEC); uveal melanoma (UVM); vaginal cancer; vulvar cancer; Waldenstrom macroglobulinemia; or Wilm's tumor. In some embodiments, the cancer comprises a gastrointestinal cancer, cancer, hepatocellular carcinoma, liver cancer, gastrointestinal stromal tumor (GIST), esophageal cancer, pancreatic cancer or colorectal cancer.

In some instances, a cancer (e.g., a primary tumor) comprises acute lymphoblastic leukemia (ALL), acute myeloid leukemia (AML), bladder cancer, breast cancer, brain cancer, cervical cancer, colon cancer, colorectal cancer, endometrial cancer, gastrointestinal cancer, glioma, glioblastoma, head and neck cancer, kidney cancer, liver cancer, lung cancer, lymphoid neoplasia, melanoma, a myeloid neoplasia, ovarian cancer, pancreatic cancer, prostate cancer, squamous cell carcinoma, testicular cancer, stomach cancer, or thyroid cancer. In some instances, a cancer includes a lymphoid neoplasia, head and neck cancer, pancreatic cancer, endometrial cancer, colon or colorectal cancer, prostate cancer, glioma or other brain/spinal cancers, ovarian cancer, lung cancer, bladder cancer, melanoma, breast cancer, a myeloid neoplasia, testicular cancer, stomach cancer, cervical, kidney, liver, or thyroid cancer. In some instances, a cancer is ALL. In some instances, the cancer is AML. In some instances, the cancer is brain cancer. In some instances, the cancer is colon cancer. In some instances, the cancer is lung cancer. In some instances, the cancer is breast cancer. In some instances, the cancer is prostate cancer.

In some instances, the cancer is a lymphoma. Lymphoma refers to a cancer of a part of the immune system called the lymph system. It is generally broken into non-Hodgkin's and Hodgkin's lymphoma.

In some instances, the cancer is a lymphoid neoplasia. Lymphoid neoplasia, as used herein, refers to a neoplasm arising from a malignant change in a B or T lymphocyte and includes, without limitation, any type of lymphoma. The two major types of lymphoma are Hodgkin's disease and non-Hodgkin lymphoma. Hodgkin disease is a relatively simple disease involving only four main types. In contrast, non-Hodgkin lymphoma (NHL) is a term applied to many different types of lymphatic cancer including the following subtypes; precursor B cell lymphoma, small lymphocytic lymphoma/chronic lymphocytic leukemia, marginal zone lymphomas (nodal marginal zone lymphoma, extranodal MALT, splenic), hairy cell leukemia, follicular lymphoma, mantle cell lymphoma, diffuse large B cell lymphoma, Burkitt's lymphoma, anaplastic large cell lymphoma, peripheral T cell lymphoma and mycosis fungoides. In some embodiments, other lymphoid neoplasms that are not strictly related to non-Hodgkin lymphoma but are included herein comprises acute lymphoblastic leukemia, lymphoplasmacytoid lymphoma, T-cell chronic lymphocytic leukemia/prolymphocytic leukemia, and any other cancers of lymphoid origin that are not easily classified.

In some instances, the cancer is head and neck cancer. Head and neck cancer is a group of biologically similar cancers that start in the upper aerodigestive tract, including the lip, oral cavity (mouth), nasal cavity (inside the nose), paranasal sinuses, pharynx, and larynx. 90% of head and neck cancers are squamous cell carcinomas (SCCHN), originating from the mucosal lining (epithelium) of these regions. Head and neck squamous cell carcinomas (HNSCC's) make up the vast majority of head and neck cancers, and arise from mucosal surfaces throughout this anatomic region. These include tumors of the nasal cavities, paranasal sinuses, oral cavity, nasopharynx, oropharynx, hypopharynx, and larynx.

In some instances, the cancer is pancreatic cancer or pancreas cancer. Pancreatic cancer is derived from pancreatic cells including but not limited to, adenocarcinomas, adenosquamous carcinomas, signet ring cell carcinomas, hepatoid carcinomas, colloid carcinomas, undifferentiated carcinomas, undifferentiated carcinomas with osteoclast-like giant cells and islet cell carcinomas.

In some instances, the cancer is endometrial cancer. Endometrial cancer is a malignancy that arises from the inner lining of the uterus (endometrium). The term refers to, but is not limited to endometrial carcinomas and endometrial adenocarcinomas. Endometrial cancers as used herein also include other well-known cell types such as papillary serous carcinoma, clear cell carcinoma, papillary endometrioid carcinoma, and mucinous carcinoma.

In some instances, the cancer is colon cancer, also called colorectal cancer or bowel cancer. Colon cancer refers to a malignancy that arises in the large intestine (colon) or the rectum (end of the colon), and includes cancerous growths in the colon, rectum, and appendix, including adenocarcinoma. Colorectal cancer is preceded by adenomas, neoplasms of epithelial origin which are derived from glandular tissue or exhibit clearly defined glandular structures.

In some instances, the cancer is prostate cancer. Prostate cancer describes an uncontrolled (malignant) growth of cells originating from the prostate gland.

In some instances, the cancer is kidney cancer, also called renal cancer. Kidney cancer is a disease in which kidney cells become malignant (cancerous) and grow out of control, forming a tumor. The most common kidney cancers first appear in the lining of tiny tubes (tubules) in the kidney, which is renal cell carcinoma.

In some instances, the cancer is thyroid cancer. Thyroid cancer refers to a cancer originating from the follicular or parafollicular thyroid cells.

In some instances, the cancer is glioma. Glioma refers to a type of cancer that starts in the brain or spine and which arises from glial cells and/or its precursors including Ependymomas (gliomas derived from ependymal cells), astrocytomas (gliomas derived from astrocytes and which includes glioblathyroida multiforme, oligodendrogliomas, (gliomas derived from oligodendrocytes) and mixed gliomas, such as oligo astrocytomas (derived from cells from different types of glia).

In some instances, the cancer is ovarian cancer. Ovarian cancer is a group of tumors that originate in the ovaries and includes, without limitation, serous ovarian cancer, non-invasive ovarian cancer, mixed phenotype ovarian cancer, mucinous ovarian cancer, endometrioid ovarian cancer, clear cell ovarian cancer, papillary serous ovarian cancer, Brenner cell, and undifferentiated adenocarcinoma.

In some instances, the cancer is lung cancer. Lung cancer refers to any uncontrolled cell growth in tissues of the lung, including but not limited to, small cell lung carcinoma, combined small cell carcinoma, non-small cell lung carcinoma, sarcomatoid carcinoma, salivary gland tumors, carcinoid tumor, adenosquamous carcinoma, pleuropulmonary blastoma and carcinoid tumor.

In some instances, the cancer is bladder cancer. Bladder cancer refers to any of several types of malignant growths of the urinary bladder and includes, without limitation, transitional cell carcinoma, squamous cell carcinoma, adenocarcinoma, sarcoma and small cell carcinoma.

In some instances, the cancer is melanoma. Melanoma refers to any form of cancer that begins in melanocytes. Melanoma includes, but is not limited to, the following subtypes: lentigo maligna, lentigo maligna melanoma, superficial spreading melanoma, acral lentiginous melanoma, mucosal melanoma, nodular melanoma, polypoid melanoma, desmoplastic melanoma, amelanotic melanoma, soft-tissue melanoma, and metastatic melanoma.

In some instances, the cancer is breast cancer. Breast cancer or malignant breast neoplasm is commonly used as the generic name for cancers originating from breast tissue, most commonly from the inner lining of milk ducts or the lobules that supply the ducts with milk. Depending on their receptor status as detected by immunohistochemistry, in particular on the presence or absence of estrogen receptor (ER), progesterone receptor (PR) and on the level of expression of HER2/neu (normal expression/under-expression vs over-expression), breast cancers may be divided into ER positive (ER+) breast cancer, ER negative (ER−) breast cancer, PR positive (PR+) breast cancer, PR negative (PR−) breast cancer, HER2 positive (HER2+) breast cancer (cancer over-expressing HER2), HER2 negative (HER2−) breast cancer (cancer expressing normal levels of HER2 or under-expressing HER2, or not expressing a detectable level of HER2), hormone receptor negative breast cancer, i.e. breast cancer with neither of estrogen nor progesterone receptors (abbreviated by ER−/PR− breast cancer); and triple negative breast cancer, i.e. breast cancer with neither of estrogen nor progesterone receptors and with normal expression/under-expression (or with the absence of detectable level of expression) of HER2 (abbreviated by ER−/PR−/HER2− breast cancer). Depending on their gene expression pattern, breast cancers in some instances are divided into luminal subtype A breast cancer, luminal subtype B breast cancer, normal-like breast cancer, HER2+ breast cancer and basal-like breast cancer (Sorlie et al. (2001) Proc. Nat. Acad. Sci. 98: 10869-10874). Luminal A and B subtypes are largely ER positive. In contrast, HER2+ breast cancers show an increased high expression of genes associated with the HER2 amplicon and normal-like breast cancers share molecular features of normal breast tissue.

In some instances, the cancer is myeloid neoplasm. Myeloid neoplasms include cancers of cells of the myeloid lineage, e.g., myeloid (myelocytic or myelogenous) leukemia derived from granulocytes (e.g., neutrophils, eosinophils, and basophils) or monocytes. In some embodiments, myeloid neoplasms include chronic myelocytic leukemia, acute myelocytic leukemia, chronic neutrophilic leukemia, chronic eosinophilic leukemia, and myelodyplastic syndromes.

In some instances, the cancer is testicular cancer. Testicular cancer is a cancer of the testicles. In some embodiments, testicular cancer includes, but is not limited to, malignant cancers such as seminomas, nonseminomas, choriocarcinoma, embryonal carcinoma, immature teratoma, yolk sac tumors, Leydig and Sertoli cell tumors, PNET, leiomyosarcoma, rhabdomyosarcoma, and mesothelioma.

In some instances, the cancer is stomach cancer. Stomach tumor or stomach cancer refers to any tumor or cancer of the stomach, including, e.g., adenocarcinomas (such as diffuse type and intestinal type), and less prevalent forms such as lymphomas, leiomyosarcomas, and squamous cell carcinomas.

Additional Methods

In specific embodiments, provided herein include methods for determining the risk of developing cancer in a patient. Biomarker methylation percentages, amounts or patterns are characteristic of various risk states, e.g., high, medium or low. The risk of developing cancer is determined by measuring the methylation status of the relevant biomarkers and then either submitting them to a classification algorithm or comparing them with a reference amount, i.e., a predefined level or pattern of methylated (and/or unmethylated) biomarkers that is associated with the particular risk level.

Determining Cancer Severity

In another embodiment, provided herein include methods for determining the severity of cancer in a patient. A particular stage or severity of cancer may have a characteristic level of hypermethylation or hypomethylation of a biomarker or relative hypermethylated or hypomethylation levels of a set of biomarkers (a pattern). In some cases, the severity of cancer is determined by measuring the methylation status of the relevant biomarkers and then either submitting them to a classification algorithm or comparing them with a reference amount, i.e., a predefined methylation level or pattern of methylated biomarkers that is associated with the particular stage.

In some embodiments, one or more biomarkers selected from tables 1-42, 8-41, and/or 56-59 are utilized for determining the severity of cancer in a patient. In some instances, one or more biomarkers selected from tables 8-41 are used for determining the severity of cancer in a patient. In some cases, one or more biomarkers selected from tables 56-57 are used for determining the severity of cancer in a patient. In some cases, one or more biomarkers selected from tables 58-59 are used for determining the severity of cancer in a patient. In some cases, one or more biomarkers selected from table 56 are used for determining the severity of cancer in a patient. In some cases, one or more biomarkers selected from table 57 are used for determining the severity of cancer in a patient. In some cases, one or more biomarkers selected from table 58 are used for determining the severity of cancer in a patient. In some cases, one or more biomarkers selected from table 59 are used for determining the severity of cancer in a patient.

Determining Cancer Prognosis

In one embodiment, provided herein include methods for determining the course of cancer in a patient, cancer course refers to changes in cancer status over time, including cancer progression (worsening) and cancer regression (improvement). Over time, the amount or relative amount (e.g., the pattern) of methylation of the biomarkers changes. For example, hypermethylation or hypomethylation of biomarker "X" and "Y" are increased in some instances with cancer. Therefore, the trend of these biomarkers, either increased or decreased methylation over time toward cancer or non-cancer indicates the course of the disease. Accordingly, this method involves measuring the methylation level or status of one or more biomarkers in a patient at least two different time points, e.g., a first time and a second time, and comparing the change, if any. The course of cancer is determined based on these comparisons.

In some embodiments, one or more biomarkers selected from tables 1-42, 8-41, and/or 56-59 are utilized for determining the course of cancer in a patient, cancer course refers to changes in cancer status over time, including cancer progression (worsening) and cancer regression (improvement). In some instances, one or more biomarkers selected from tables 8-41 are used for determining the course of cancer in a patient, cancer course refers to changes in cancer status over time, including cancer progression (worsening) and cancer regression (improvement). In some cases, one or more biomarkers selected from tables 56-57 are used for determining the course of cancer in a patient, cancer course refers to changes in cancer status over time, including cancer progression (worsening) and cancer regression (improvement). In some cases, one or more biomarkers selected from tables 58-59 are used for determining the course of cancer in a patient, cancer course refers to changes in cancer status over time, including cancer progression (worsening) and cancer regression (improvement). In some cases, one or more biomarkers selected from table 56 are used for determining the course of cancer in a patient, cancer course refers to changes in cancer status over time, including cancer progression (worsening) and cancer regression (improvement). In some cases, one or more biomarkers selected from table 57 are used for determining the course of cancer in a patient, cancer course refers to changes in cancer status over time, including cancer progression (worsening) and cancer regression (improvement). In some cases, one or more biomarkers selected from table 58 are used for determining the course of cancer in a patient, cancer course refers to changes in cancer status over time, including cancer progression (worsening) and cancer regression (improvement). In some cases, one or more biomarkers selected from table 59 are used for determining the course of cancer in a patient, cancer course refers to changes in cancer status over time, including cancer progression (worsening) and cancer regression (improvement).

Patient Management

In certain embodiments of the methods of qualifying cancer status, the methods further comprise managing patient treatment based on the status. Such management includes the actions of the physician or clinician subsequent to determining cancer status. For example, if a physician makes a diagnosis or prognosis of cancer, then a certain regime of monitoring would follow. An assessment of the course of cancer using the methods of the present invention then requires a certain cancer therapy regimen. Alternatively, a diagnosis of non-cancer follows with further testing to determine a specific disease that the patient suffers from. Optionally, further tests are called for if the diagnostic test gives an inconclusive result on cancer status.

In some embodiments, one or more biomarkers selected from tables 1-42, 8-41, and/or 56-59 are utilized for qualifying cancer status. In some instances, one or more biomarkers selected from tables 8-41 are used for qualifying cancer status. In some cases, one or more biomarkers selected from tables 56-57 are used for qualifying cancer status. In some cases, one or more biomarkers selected from tables 58-59 are used for qualifying cancer status. In some cases, one or more biomarkers selected from table 56 are used for qualifying cancer status. In some cases, one or more biomarkers selected from table 57 are used for qualifying cancer status. In some cases, one or more biomarkers selected from table 58 are used for qualifying cancer status. In some cases, one or more biomarkers selected from table 59 are used for qualifying cancer status.

Determining Therapeutic Efficacy of Pharmaceutical Drug

In another embodiment, provided herein include methods for determining the therapeutic efficacy of a pharmaceutical drug. These methods are useful in performing clinical trials of the drug, as well as monitoring the progress of a patient on the drug.

Therapy or clinical trials involve administering the drug in a particular regimen. In some instances, the regimen involves a single dose of the drug or multiple doses of the drug over time. The doctor or clinical researcher monitors the effect of the drug on the patient or subject over the course of administration. If the drug has a pharmacological impact on the condition, the amounts or relative amounts (e.g., the pattern or profile) of hypermethylation or hypomethylation of one or more of the biomarkers of the present invention are changed toward a non-cancer profile.

In some instances, the course of the methylation status of one or more biomarkers in the patient is followed during the course of treatment. Accordingly, this method involves measuring methylation levels of one or more biomarkers in a patient receiving drug therapy, and correlating the levels with the cancer status of the patient (e.g., by comparison to predefined methylation levels of the biomarkers that correspond to different cancer statuses). One embodiment of this method involves determining the methylation levels of one or more biomarkers at least two different time points during a course of drug therapy, e.g., a first time and a second time, and comparing the change in methylation levels of the biomarkers, if any. For example, the methylation levels of one or more biomarkers are measured before and after drug administration or at two different time points during drug administration. The effect of therapy is determined based on these comparisons. If a treatment is effective, then the methylation status of one or more biomarkers trend toward normal, while if treatment is ineffective, the methylation status of one or more biomarkers trend toward cancer indications.

In some embodiments, one or more biomarkers selected from tables 1-42, 8-41, and/or 56-59 are utilized for determining the therapeutic efficacy of a pharmaceutical drug. In some instances, one or more biomarkers selected from tables 8-41 are used for determining the therapeutic efficacy of a pharmaceutical drug. In some cases, one or more biomarkers selected from tables 56-57 are used for determining the therapeutic efficacy of a pharmaceutical drug. In some cases, one or more biomarkers selected from tables 58-59 are used for determining the therapeutic efficacy of a pharmaceutical drug. In some cases, one or more biomarkers selected from table 56 are used for determining the therapeutic efficacy of a pharmaceutical drug. In some cases, one or more biomarkers selected from table 57 are used for determining the therapeutic efficacy of a pharmaceutical drug. In some cases, one or more biomarkers selected from table 58 are used for determining the therapeutic efficacy of a pharmaceutical drug. In some cases, one or more biomarkers selected from table 59 are used for determining the therapeutic efficacy of a pharmaceutical drug.

Generation of Classification Algorithms for Qualifying Cancer Status

In some embodiments, one or more pattern recognition methods are used in analyzing the methylation values measured for markers of a biomarker panel correlated to the underlying diagnostic question. In some cases, the pattern recognition method comprises a linear combination of methylation levels, or a nonlinear combination of methylation levels to extract the probability that a biological sample is from a patient who exhibits no evidence of disease, who exhibits systemic cancer, or who exhibits biochemical recurrence, as well as to distinguish these disease states and types, particularly the primary tumor type. In some cases, the models and/or algorithms are provided in machine-readable format, and are used to correlate methylation levels or a methylation profile with a disease state, and/or to designate a treatment modality for a patient or class of patients.

In some embodiments, assaying the methylation level for a plurality of targets comprises the use of an algorithm or classifier. Array data is managed, classified, and analyzed using techniques known in the art and described herein. In some cases, assaying the methylation level for a plurality of targets comprises probe set modeling and data pre-processing. In some instances, probe set modeling and data pre-processing are derived using the Robust Multi-Array (RMA) algorithm or variants GC-RMA, RMA, Probe Logarithmic Intensity Error (PLIER) algorithm or variant iterPLIER. Variance or intensity filters are applied to pre-process data using the RMA algorithm, for example by removing target sequences with a standard deviation of <10 or a mean intensity of <100 intensity units of a normalized data range, respectively.

In some embodiments, data that are generated using samples such as "known samples" or "control" are then used to "train" a classification model. A "known sample" is a sample that has been pre-classified, such as, for example, a suitable control (e.g., biomarkers) from a non-diseased or non-cancer "normal" sample and/or suitable control (e.g., biomarkers from a known tumor tissue type or stage, or cancer status. The data that are used to form the classification model are referred to as a "training data set." In some cases, the training data set that is used to form the classification model comprises raw data or pre-processed data. Once trained, the classification model recognizes patterns in data generated using unknown samples. In some instances, the classification model is then used to classify the unknown samples into classes. This is useful, for example, in predicting whether or not a particular biological sample is associated with a certain biological condition (e.g., diseased versus non-diseased).

Once the model has been constructed, and validated, it is packaged to be accessible to end-users. For example, this involves implementation of a spreadsheet application, or an alternative form for visual representation, into which the model has been imbedded, scripting of a statistical software package, or refactoring of the model into a hard-coded application by information technology staff.

In some embodiments, the classification models are formed on and used on any suitable digital computer. Suitable digital computers include micro, mini, or large computers using any standard or specialized operating system, such as a Unix, Windows® or Linux™ based operating system. In embodiments utilizing a mass spectrometer, the digital computer that is used is physically separate from the mass spectrometer that is used to create the spectra of interest, or it is coupled to the mass spectrometer.

The training data set and the classification models according to embodiments of the invention are embodied by computer code that is executed or used by a digital computer. The computer code are stored on any suitable computer readable media including optical or magnetic disks, sticks, tapes, etc., and can be written in any suitable computer programming language including R, C, C++, visual basic, etc.

The learning algorithms described above are useful both for developing classification algorithms for the biomarker biomarkers already discovered, and for finding new biomarker biomarkers. The classification algorithms, in turn, form the base for diagnostic tests by providing diagnostic values (e.g., cut-off points) for biomarkers used singly or in combination.

Computer Systems, Platforms, and Programs

In some aspects, described herein relates to a computer system or platform that is provided with means for implementing one or more method described herein. In some embodiments, the computer system includes: (a) at least one memory containing at least one computer program adapted to control the operation of the computer system to implement a method that includes: (i) receiving DNA methylation data e.g., the methylation profile of a CUP and the methylation profile of one or more primary tumors, (ii) determining the degree of identity between the methylation profile of the CUP and the methylation profile of the primary tumors and (b) at least one processor for executing the computer program. In some embodiments, a platform comprises one or more computer systems.

Another aspect described herein relates to a computer program for controlling a computer system to execute the steps according one or more methods described herein.

In some embodiments, a computer system refers to a system having a computer, where the computer comprises a computer-readable medium embodying software to operate the computer. In some cases, the computer system includes one or more general or special purpose processors and associated memory, including volatile and non-volatile memory devices. In some cases, the computer system memory stores software or computer programs for controlling the operation of the computer system to make a special purpose system according to the invention or to implement a system to perform the methods according to the invention. In some cases, the computer system includes an Intel or AMD x86 based single or multi-core central processing unit (CPU), an ARM processor or similar computer processor for processing the data. In some cases, the CPU or microprocessor is any conventional general purpose single- or multi-chip microprocessor such as an Intel Pentium processor, an Intel 8051 processor, a RISC or MISS processor, a Power PC processor, or an ALPHA processor. In some cases, the microprocessor is any conventional or special purpose microprocessor such as a digital signal processor or a graphics processor. The microprocessor typically has conventional address lines, conventional data lines, and one or more conventional control lines. As described below, the software according to the invention is executed on dedicated system or on a general purpose computer having a DOS, CPM, Windows, Unix, Linix or other operating system. In some instances, the system includes non-volatile memory, such as disk memory and solid state memory for storing computer programs, software and data and volatile memory, such as high speed ram for executing programs and software.

In some embodiments, a computer-readable medium refers to any storage device used for storing data accessible by a computer, as well as any other means for providing access to data by a computer. Examples of a storage device-type computer-readable medium include: a magnetic hard disk; a floppy disk; an optical disk, such as a CD-ROM and a DVD; a magnetic tape; a memory chip. Computer-readable physical storage media useful in various embodiments of the invention can include any physical computer-readable storage medium, e.g., solid state memory (such as flash memory), magnetic and optical computer-readable storage media and devices, and memory that uses other persistent storage technologies. In some embodiments, a computer readable media is any tangible media that allows computer programs and data to be accessed by a computer. Computer readable media can include volatile and nonvolatile, removable and non-removable tangible media implemented in any method or technology capable of storing information such as computer readable instructions, program modules, programs, data, data structures, and database information. In some embodiments of the invention, computer readable media includes, but is not limited to, RAM (random access memory), ROM (read only memory), EPROM (erasable programmable read only memory), EEPROM (electrically erasable programmable read only memory), flash memory or other memory technology, CD-ROM (compact disc read only memory), DVDs (digital versatile disks) or other optical storage media, magnetic cassettes, magnetic tape, magnetic disk storage or other magnetic storage media, other types of volatile and nonvolatile memory, and any other tangible medium which can be used to store information and which can read by a computer including and any suitable combination of the foregoing.

In some instances, one or more methods described herein are implemented on a stand-alone computer or as part of a networked computer system or computing platform. In a stand-alone computer, all the software and data can reside on local memory devices, for example an optical disk or flash memory device can be used to store the computer software for implementing the invention as well as the data. In alternative embodiments, the software or the data or both can be accessed through a network connection to remote devices. In one networked computer system or computing platform embodiment, the invention use a client-server environment over a public network, such as the internet or a private network to connect to data and resources stored in remote and/or centrally located locations. In this embodiment, a server including a web server can provide access, either open access, pay as you go or subscription based access to the information provided according to the invention. In a client server environment, a client computer executing a client software or program, such as a web browser, connects to the server over a network. The client software or web browser provides a user interface for a user of the invention to input data and information and receive access to data and information. In some cases, the client software is viewed on a local computer display or other output device and can allow the user to input information, such as by using a computer keyboard, mouse or other input device. The server executes one or more computer programs that enable the client software to input data, process data according to the invention and output data to the user, as well as provide access to local and remote computer resources. For example, the user interface can include a graphical user interface comprising an access element, such as a text box, that permits entry of data from the assay, e.g., the DNA methylation data levels or DNA gene expression levels of target genes of a reference pluripotent stem cell population and/or pluripotent stem cell population of interest, as well as a display element that can provide a graphical read out of the results of a comparison with a score card, or data sets transmitted to or made available by a processor following execution of the instructions encoded on a computer-readable medium. As used herein, the term "software" is used interchangeably with "program" and refers to prescribed rules to operate a computer. Examples of software include: software; code segments; instructions; computer programs; and programmed logic.

In some embodiments, the methylation profiles from primary tumors, which are used as references can be electronically or digitally recorded, annotated and retrieved from databases including, but not limited to GenBank (NCBI) protein and DNA databases such as genome, ESTs, SNPS, Traces, Celara, Ventor Reads, Watson reads, HGTS, etc.; Swiss Institute of Bioinformatics databases, such as ENZYME, PROSITE, SWISS-2DPAGE, Swiss-Prot and TrEMBL databases; the Melanie software package or the ExPASy WWW server, etc., the SWISS-MODEL, Swiss-Shop and other network-based computational tools; the Comprehensive Microbial Resource database (The institute of Genomic Research). In some cases, the resulting information is stored in a relational data base that is employed to determine homologies between the reference data or genes or proteins within and among genomes.

In some embodiments, the system compares the data in a "comparison module" which uses a variety of available software programs and formats for the comparison operative to compare sequence information determined in the determination module to reference data. In one embodiment, the comparison module is configured to use pattern recognition techniques to compare sequence information from one or more entries to one or more reference data patterns. The comparison module may be configured using existing commercially-available or freely-available software for comparing patterns, and may be optimized for particular data comparisons that are conducted. The comparison module can also provide computer readable information related to the sequence information that can include, for example, detection of the presence or absence of a CpG methylation sites in DNA sequences; determination of the level of methylation.

In some embodiments, the comparison module provides computer readable comparison result that can be processed in computer readable form by predefined criteria, or criteria defined by a user, to provide a report which comprises content based in part on the comparison result that may be stored and output as requested by a user using a display module. In some embodiments, a display module enables display of a content based in part on the comparison result for the user, wherein the content is a report indicative of the results of the comparison of methylation profile of the CUP of interest with the methylation profile of a tumor cell.

In some embodiments, the display module enables display of a report or content based in part on the comparison result for the end user, wherein the content is a report indicative of the results of the comparison of the methylation profile of the CUP with the methylation profile of the selected primary tumors. In some embodiments of this aspect and all other aspects of the present invention, the comparison module, or any other module of the invention, can include an operating system (e.g., UNIX, Windows) on which runs a relational database management system, a World Wide Web application, and a World Wide Web server. World Wide Web application can includes the executable code necessary for generation of database language statements [e.g., Standard Query Language (SQL) statements]. The executables can include embedded SQL statements. In addition, the World Wide Web application may include a configuration file which contains pointers and addresses to the various software entities that comprise the server as well as the various external and internal databases which must be accessed to service user requests. The Configuration file also directs requests for server resources to the appropriate hardware as may be necessary should the server be distributed over two or more separate computers. In one embodiment, the World Wide Web server supports a TCP/IP protocol. Local networks such as this are sometimes referred to as "Intranets." An advantage of such Intranets is that they allow easy communication with public domain databases residing on the World Wide Web (e.g., the GenBank or Swiss Pro World Wide Web site), such as The Cancer Genome Atlas (TCGA) or the International Cancer Genome Consortium (ICGC), and the like. Thus, in a particular embodiment of the present invention, users can directly access data (via Hypertext links for example) residing on Internet databases using an HTML, interface provided by Web browsers and Web servers. In other embodiments of the invention, other interfaces, such as HTTP, FTP, SSH and VPN based interfaces can be used to connect to the Internet databases.

In some instances, computer instructions are implemented in software, firmware or hardware and include any type of programmed step undertaken by modules of the information processing system. In some cases, the computer system is connected to a local area network (LAN) or a wide area network (WAN). One example of the local area network can be a corporate computing network, including access to the Internet, to which computers and computing devices comprising the data processing system are connected. In one embodiment, the LAN uses the industry standard Transmission Control Protocol/Internet Protocol (TCP/IP) network protocols for communication. Transmission Control Protocol Transmission Control Protocol (TCP) can be used as a transport layer protocol to provide a reliable, connection-oriented, transport layer link among computer systems. The network layer provides services to the transport layer. Using a two-way handshaking scheme, TCP provides the mechanism for establishing, maintaining, and terminating logical connections among computer systems. TCP transport layer uses IP as its network layer protocol. Additionally, TCP provides protocol ports to distinguish multiple programs executing on a single device by including the destination and source port number with each message. TCP performs functions such as transmission of byte streams, data flow definitions, data acknowledgments, lost or corrupt data retransmissions, and multiplexing multiple connections through a single network connection. Finally, TCP is responsible for encapsulating information into a datagram structure. In alternative embodiments, the LAN can conform to other network standards, including, but not limited to, the International Standards Organization's Open Systems Interconnection, IBM's SNA, Novell's Netware, and Banyan VINES.

In some embodiments, a comparison module provides computer readable data that can be processed in computer readable form by predefined criteria, or criteria defined by a user, to provide a retrieved content that may be stored and output as requested by a user using a display module. In accordance with some embodiments of the invention, the computerized system can include or be operatively connected to a display module, such as computer monitor, touch screen or video display system. The display module allows user instructions to be presented to the user of the system, to view inputs to the system and for the system to display the results to the user as part of a user interface. Optionally, the computerized system can include or be operative connected to a printing device for producing printed copies of information output by the system.

In some embodiments, a World Wide Web browser can be used to provide a user interface to allow the user to interact with the system to input information, construct requests and to display retrieved content. In addition, the various functional modules of the system can be adapted to use a web browser to provide a user interface. Using a Web browser, a user can construct requests for retrieving data from data sources, such as data bases and interact with the comparison module to perform comparisons and pattern matching. The user can point to and click on user interface elements such as buttons, pull down menus, scroll bars, etc. conventionally employed in graphical user interfaces to interact with the system and cause the system to perform the methods of the invention. The requests formulated with the user's Web browser can be transmitted over a network to a Web application that can process or format the request to produce a query of one or more database that can be employed to provide the pertinent information related to the DNA methylation levels and gene expression levels, the retrieved content, process this information and output the results.

Server

Figure 2:
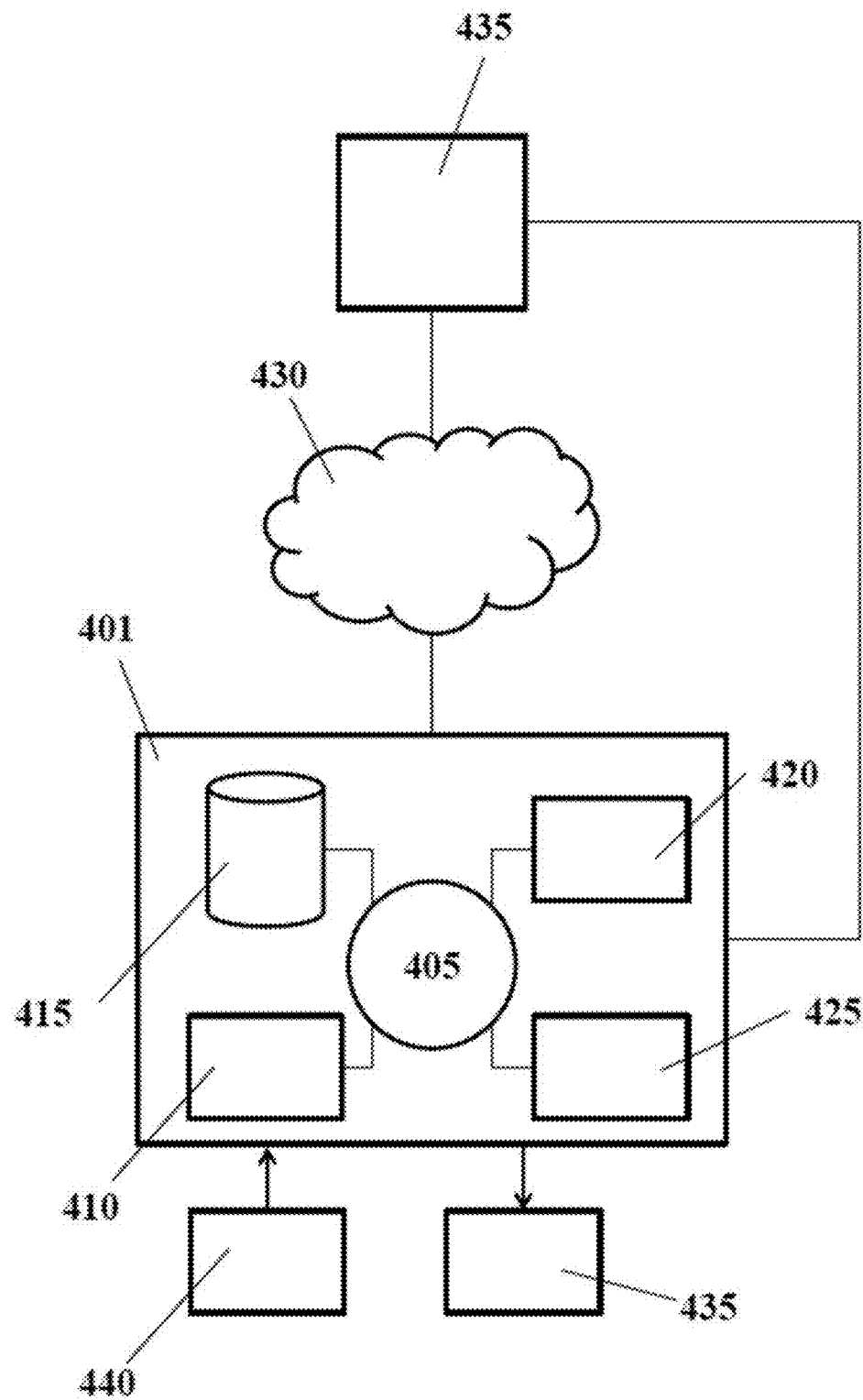
FIG. 2 illustrates a diagram of the computer system disclosed herein.
Figure 3:
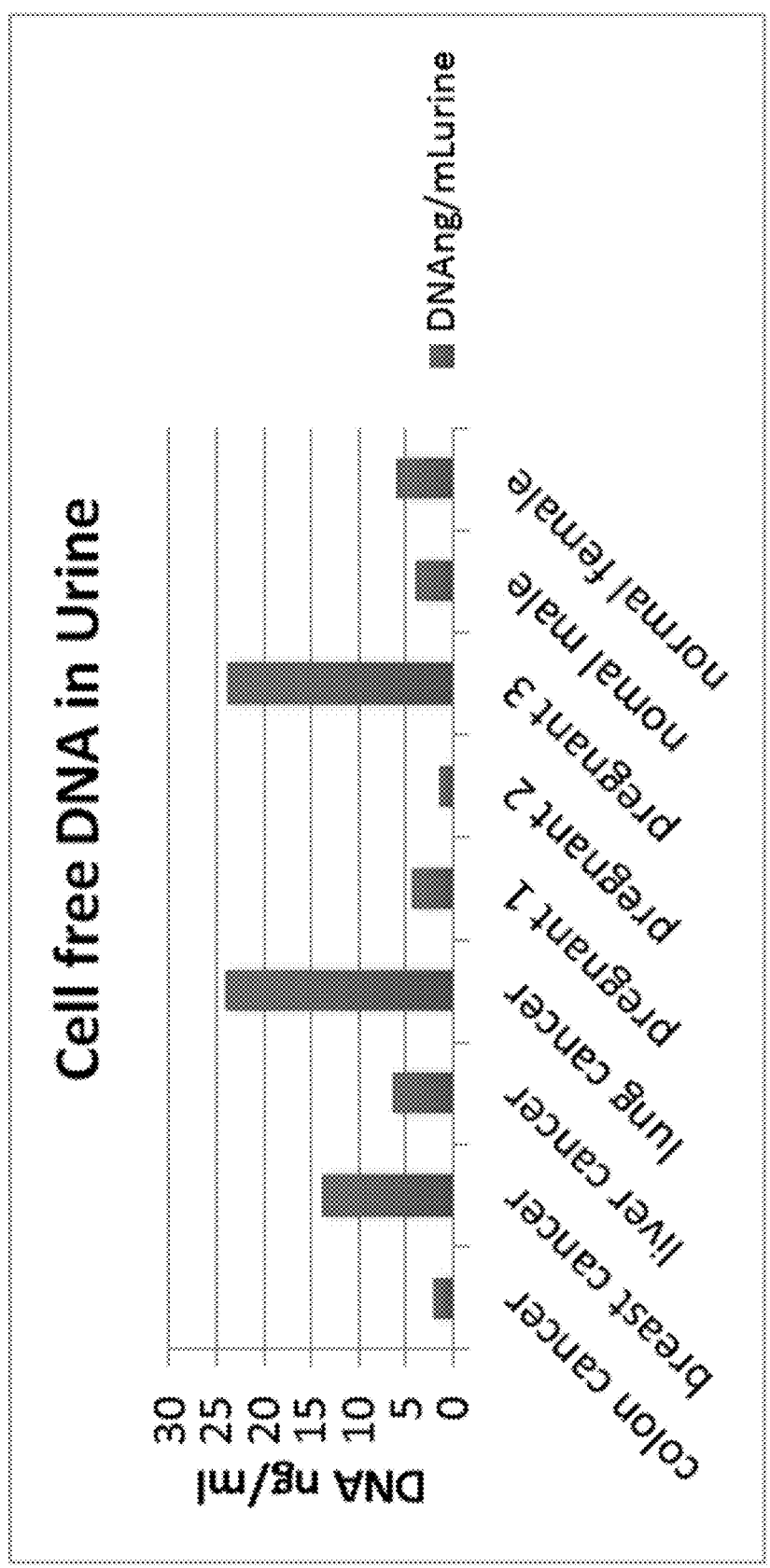
FIG. 3 illustrates yield of cell free DNA from urine. Cell free DNA in urine varied between 1-30 ng per 1 ml urine, which is about ⅕ of the concentration observed in plasma. The range varies between samples from different individuals and also depends on other factors, e.g., gender, certain disease states.
Figure 4:
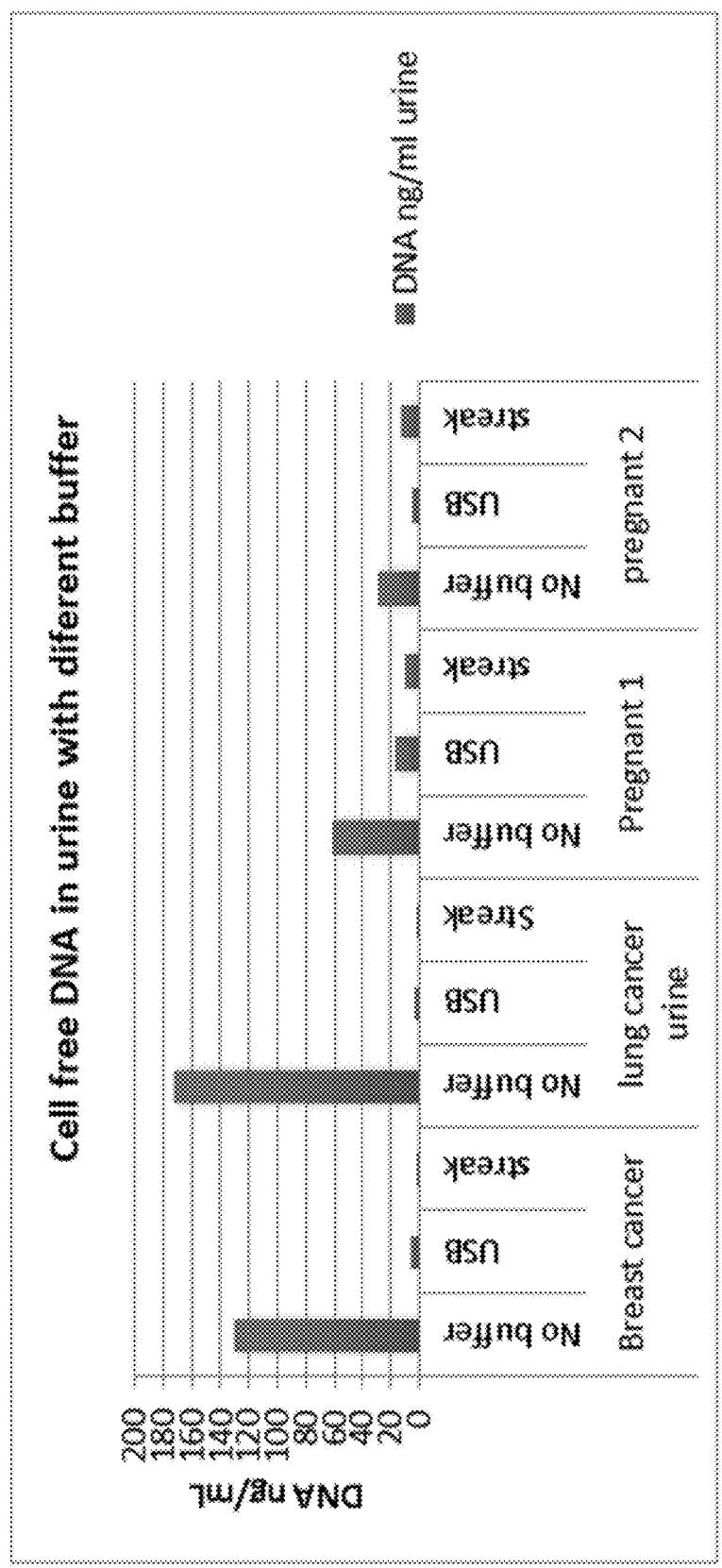
FIG. 4 illustrates effect of urine stable buffer (USB) on cell free DNA yield from urine. The urine samples were kept at room temperature for 14 days after mixing with USB buffer or another commercial buffer streak. After 14 days, the release of genomic DNA from no buffer samples yielded much higher DNA. But USB or streak buffer prevented the release of cell DNA.
Figure 5:
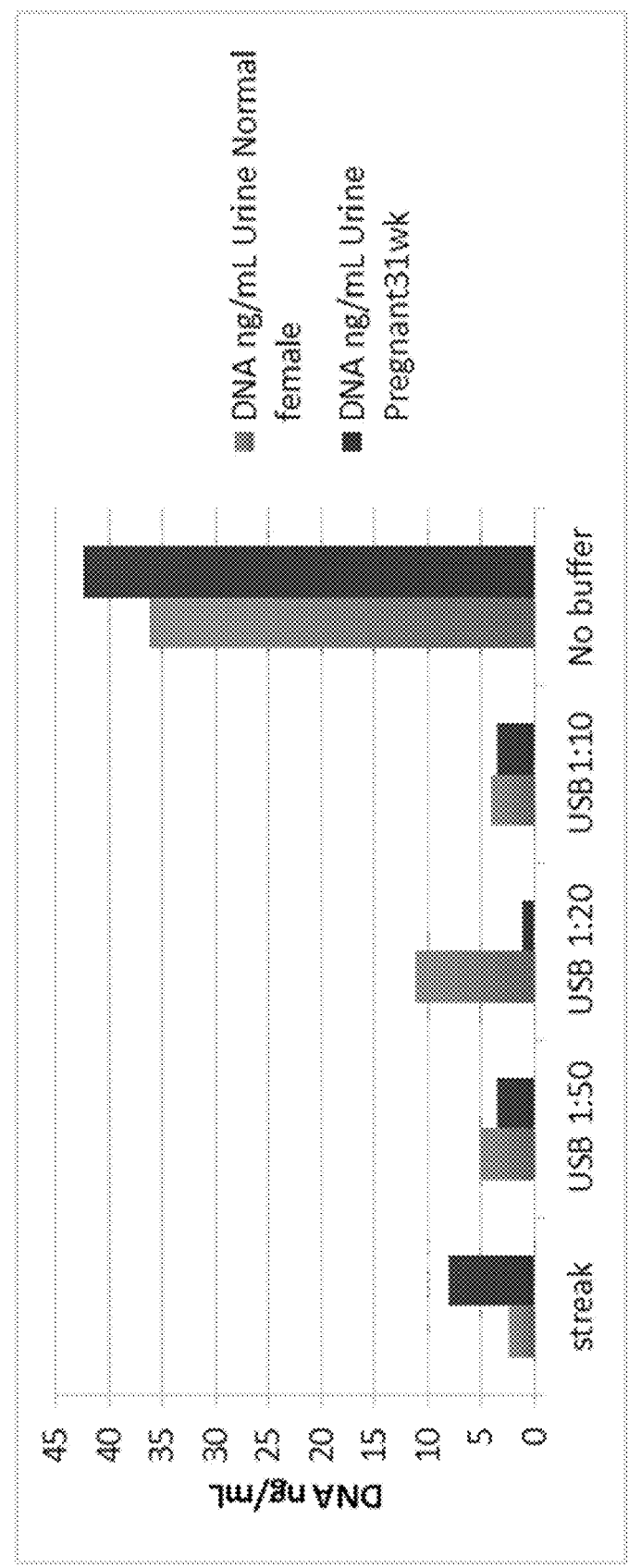
FIG. 5 illustrates yield of DNA using different working concentrations of USB. The yield of DNA in different ratio of urine stable buffer in urine, compared with commercial streak buffer or without buffer illustrates that USB buffer works from 1:10 to 1:50 diluted to urine.
Figure 6:
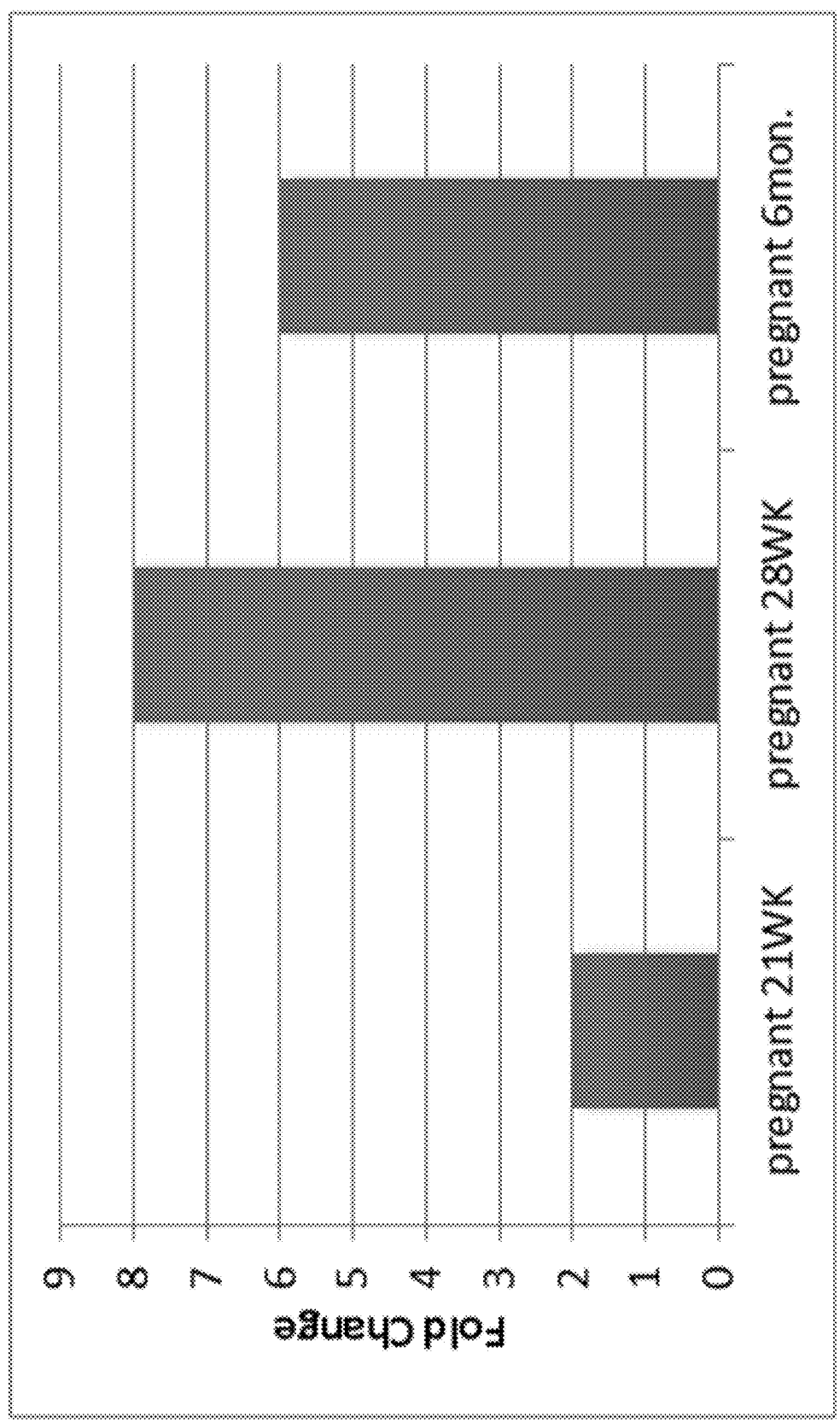
FIG. 6 illustrates the fold change in the detection signal for fetal DNA in plasma compared with urine. Starting with 4 ml of starting sample of plasma and urine, the signal of male fetal DNA was detected in cell free DNA by q-rt PCR with male specific SRY gene. The signal is about 2-8 times stronger in plasma than in urine with the same volume.
Figure 7:
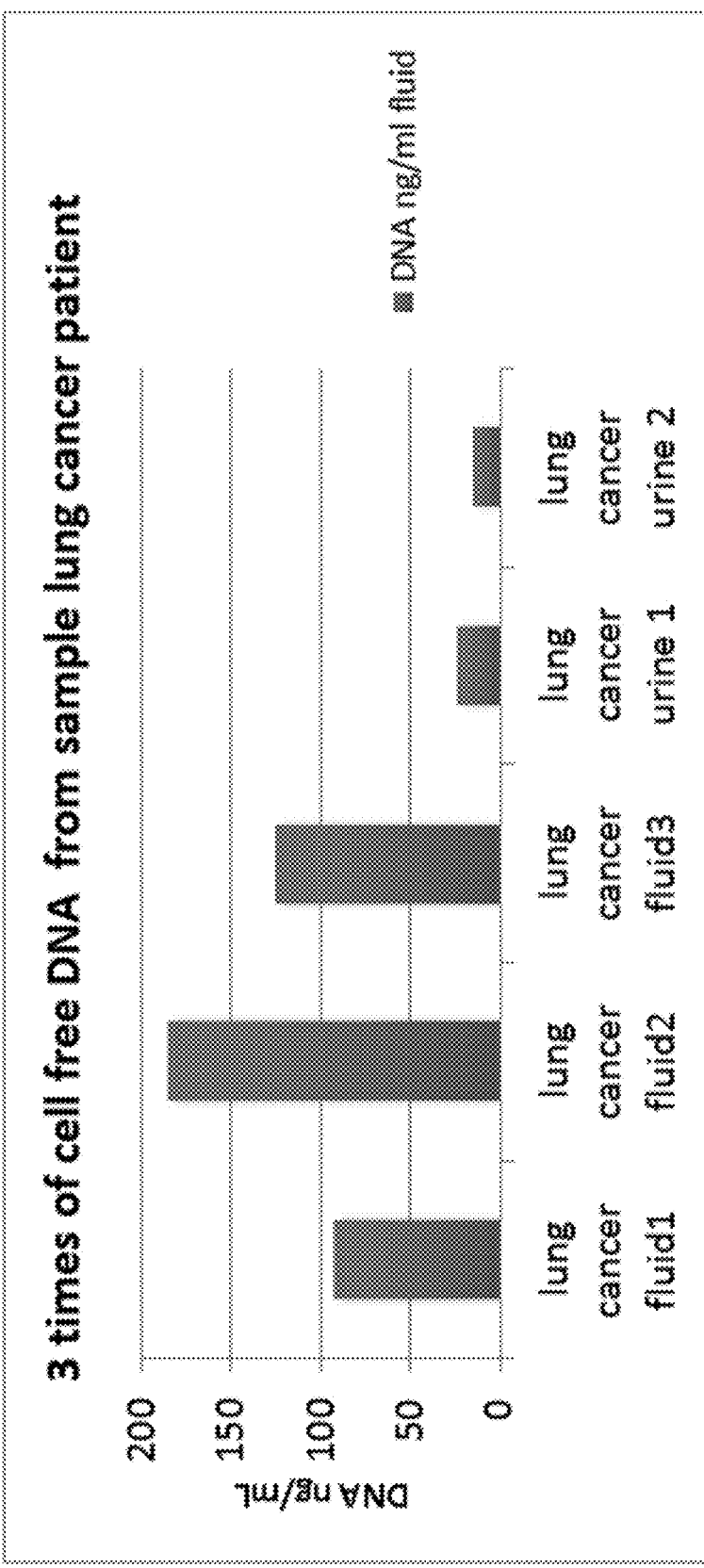
FIG. 7 illustrates the yield of cell free DNA in urine and lung fluid from one lung cancer patient at different time points. The average cell free DNA in lung fluid is about 130 ng/mL and in urine is about 20 ng/mL.

In some embodiments, the methods provided herein are processed on a server or a computer server (FIG. 2). In some embodiments, the server 401 includes a central processing unit (CPU, also "processor") 405 which is a single core processor, a multi core processor, or plurality of processors for parallel processing. In some embodiments, a processor used as part of a control assembly is a microprocessor. In some embodiments, the server 401 also includes memory 410 (e.g. random access memory, read-only memory, flash memory); electronic storage unit 415 (e.g. hard disk); communications interface 420 (e.g. network adaptor) for communicating with one or more other systems; and peripheral devices 425 which includes cache, other memory, data storage, and/or electronic display adaptors. The memory 410, storage unit 415, interface 420, and peripheral devices 425 are in communication with the processor 405 through a communications bus (solid lines), such as a motherboard. In some embodiments, the storage unit 415 is a data storage unit for storing data. The server 401 is operatively coupled to a computer network ("network") 430 with the aid of the communications interface 420. In some embodiments, a processor with the aid of additional hardware is also operatively coupled to a network. In some embodiments, the network 430 is the Internet, an intranet and/or an extranet, an intranet and/or extranet that is in communication with the Internet, a telecommunication or data network. In some embodiments, the network 430 with the aid of the server 401, implements a peer-to-peer network, which enables devices coupled to the server 401 to behave as a client or a server. In some embodiments, the server is capable of transmitting and receiving computer-readable instructions (e.g., device/system operation protocols or parameters) or data (e.g., sensor measurements, raw data obtained from detecting metabolites, analysis of raw data obtained from detecting metabolites, interpretation of raw data obtained from detecting metabolites, etc.) via electronic signals transported through the network 430. Moreover, in some embodiments, a network is used, for example, to transmit or receive data across an international border.

In some embodiments, the server 401 is in communication with one or more output devices 435 such as a display or printer, and/or with one or more input devices 440 such as, for example, a keyboard, mouse, or joystick. In some embodiments, the display is a touch screen display, in which case it functions as both a display device and an input device. In some embodiments, different and/or additional input devices are present such an enunciator, a speaker, or a microphone. In some embodiments, the server uses any one of a variety of operating systems, such as for example, any one of several versions of Windows®, or of MacOS®, or of Unix®, or of Linux®.

In some embodiments, the storage unit 415 stores files or data associated with the operation of a device, systems or methods described herein.

In some embodiments, the server communicates with one or more remote computer systems through the network 430. In some embodiments, the one or more remote computer systems include, for example, personal computers, laptops, tablets, telephones, Smart phones, or personal digital assistants.

In some embodiments, a control assembly includes a single server 401. In other situations, the system includes multiple servers in communication with one another through an intranet, extranet and/or the Internet.

In some embodiments, the server 401 is adapted to store device operation parameters, protocols, methods described herein, and other information of potential relevance. In some embodiments, such information is stored on the storage unit 415 or the server 401 and such data is transmitted through a network.

Kits and Articles of Manufacture

In another aspect, the present invention provides kits for detecting and/or characterizing cancer status, and/or generation of a CpG methylation profile database, wherein the kit comprises a plurality of primers or probes to detect or measure the methylation status/levels of one or more samples described herein. Such kits comprise, in some instances, at least one polynucleotide that hybridizes to at least one of the methylation biomarker sequences of the present invention and at least one reagent for detection of gene methylation. Reagents for detection of methylation include, e.g., sodium bisulfate, polynucleotides designed to hybridize to sequence that is the product of a marker sequence if the marker sequence is not methylated (e.g., containing at least one C-U conversion), and/or a methylation-sensitive or methylation-dependent restriction enzyme. In some cases, the kits provide solid supports in the form of an assay apparatus that is adapted to use in the assay. In some instances, the kits further comprise detectable labels, optionally linked to a polynucleotide, e.g., a probe, in the kit.

In some embodiments, the kits of the invention comprise one or more (e.g., 1, 2, 3, 4, or more) different polynucleotides (e.g., primers and/or probes) capable of specifically amplifying at least a portion of a DNA region of a biomarker of the present invention. In some instances, the kits comprise a probe panel, in which each probe within said probe panel comprises about 60%-99% sequence identity to a probe of SEQ ID NOs: 1-1775. Optionally, one or more detectably-labeled polypeptides capable of hybridizing to the amplified portion are also included in the kit. In some embodiments, the kits comprise sufficient primers to amplify 2, 3, 4, 5, 6, 7, 8, 9, 10, or more different DNA regions or portions thereof, and optionally include detectably-labeled polynucleotides capable of hybridizing to each amplified DNA region or portion thereof. The kits further can comprise a methylation-dependent or methylation sensitive restriction enzyme and/or sodium bisulfite.

In some embodiments, the kits comprise sodium bisulfite, primers and adapters (e.g., oligonucleotides that can be ligated or otherwise linked to genomic fragments) for whole genome amplification, and polynucleotides (e.g., detectably-labeled polynucleotides) to quantify the presence of the converted methylated and or the converted unmethylated sequence of at least one cytosine from a DNA region of a biomarker of the present invention.

In some embodiments, the kits comprise methylation sensing restriction enzymes (e.g., a methylation-dependent restriction enzyme and/or a methylation-sensitive restriction enzyme), primers and adapters for whole genome amplification, and polynucleotides to quantify the number of copies of at least a portion of a DNA region of a biomarker of the present invention.

In some embodiments, the kits comprise a methylation binding moiety and one or more polynucleotides to quantify the number of copies of at least a portion of a DNA region of a biomarker of the present invention. A methylation binding moiety refers to a molecule (e.g., a polypeptide) that specifically binds to methyl-cytosine. Examples include restriction enzymes or fragments thereof that lack DNA cutting activity but retain the ability to bind methylated DNA, antibodies that specifically bind to methylated DNA, etc.).

In some embodiments, the kit includes a packaging material. As used herein, the term "packaging material" can refer to a physical structure housing the components of the kit. In some instances, the packaging material maintains sterility of the kit components, and is made of material commonly used for such purposes (e.g., paper, corrugated fiber, glass, plastic, foil, ampules, etc.). Other materials useful in the performance of the assays are included in the kits, including test tubes, transfer pipettes, and the like. In some cases, the kits also include written instructions for the use of one or more of these reagents in any of the assays described herein.

In some embodiments, kits also include a buffering agent, a preservative, or a protein/nucleic acid stabilizing agent. In some cases, kits also include other components of a reaction mixture as described herein. For example, kits include one or more aliquots of thermostable DNA polymerase as described herein, and/or one or more aliquots of dNTPs. In some cases, kits also include control samples of known amounts of template DNA molecules harboring the individual alleles of a locus. In some embodiments, the kit includes a negative control sample, e.g., a sample that does not contain DNA molecules harboring the individual alleles of a locus. In some embodiments, the kit includes a positive control sample, e.g., a sample containing known amounts of one or more of the individual alleles of a locus.

Certain Terminologies

Unless defined otherwise, all technical and scientific terms used herein have the same meaning as is commonly understood by one of skill in the art to which the claimed subject matter belongs. It is to be understood that the foregoing general description and the following detailed description are exemplary and explanatory only and are not restrictive of any subject matter claimed. In this application, the use of the singular includes the plural unless specifically stated otherwise. It must be noted that, as used in the specification and the appended claims, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used herein, ranges and amounts can be expressed as "about" a particular value or range. About also includes the exact amount. Hence "about 5 μL" means "about 5 μL" and also "5 μL." Generally, the term "about" includes an amount that would be expected to be within experimental error.

The section headings used herein are for organizational purposes only and are not to be construed as limiting the subject matter described.

As used herein, the terms "individual(s)", "subject(s)" and "patient(s)" mean any mammal. In some embodiments, the mammal is a human. In some embodiments, the mammal is a non-human.

A "site" corresponds to a single site, which may be a single base position or a group of correlated base positions, e.g., a CpG site. A "locus" corresponds to a region that includes multiple sites. In some instances, a locus includes one site.

As used herein, the term "comparing" refers to making an assessment of how the methylation status, proportion, level or genomic localization of one or more biomarkers in a sample from a patient relates to the methylation status, proportion, level or genomic localization of the corresponding one or more biomarkers in a standard or control sample. For example, "comparing" may refer to assessing whether the methylation status, proportion, level, or cellular localization of one or more biomarkers in a sample from a patient is the same as, more or less than, or different from the methylation status, proportion, level, or cellular localization of the corresponding one or more biomarkers in standard or control sample. In one embodiment, the term comparing refers to the assessment of one or more samples in comparison (same as, more or less than, or different) to multiple standard or control samples.

The term "statistically significant" or "significantly" refers to statistical significance and generally means a two standard deviation (2 SD) below normal, or lower, concentration of the marker. The term refers to statistical evidence that there is a difference. It is defined as the probability of making a decision to reject the null hypothesis when the null hypothesis is actually true. The decision is often made using the p-value.

The term "prognosis" or "predict" refers to a forecast or calculation of risk of developing cancer or a disease or a tumor type, and how a patient will progress, and whether there is a chance of recovery. "Cancer prognosis" generally refers to a forecast or prediction of the probable course or outcome of the cancer and/or patient, assessing the risk of cancer occurrence or recurrence, determining treatment modality, or determining treatment efficacy or responses. Prognosis can use the information of the individual as well as external data to compare against the information of the individual, such as population data, response rate for survivors, family or other genetic information, and the like. "Prognosis" is also used in the context of predicting disease progression, in particular to predict therapeutic results of a certain therapy of the disease, in particular neoplastic conditions, or tumor types. The prognosis of a therapy is e.g. used to predict a chance of success (i.e. curing a disease) or chance of reducing the severity of the disease to a certain level. As a general concept, markers screened for this purpose are preferably derived from sample data of patients treated according to the therapy to be predicted. The marker sets may also be used to monitor a patient for the emergence of therapeutic results or positive disease progressions.

The term "level of cancer" or "cancer status" refers to whether cancer exists, a stage of a cancer, a size of tumor, whether there is metastasis, the total tumor burden of the body, the location and/or origin of the cancer, and/or other measure of a severity of a cancer. The level of cancer could be a number or other characters. In some cases, the level is zero. In some cases, the level of cancer also includes premalignant or precancerous conditions (states) associated with mutations or a number of mutations.

As used herein, the term "treating" and "treatment" refers to administering to a subject an effective amount of a composition so that the subject as a reduction in at least one symptom of the disease or an improvement in the disease, for example, beneficial or desired clinical results. For purposes of this invention, beneficial or desired clinical results include, but are not limited to, alleviation of one or more symptoms, diminishment of extent of disease, stabilized (e.g., not worsening) state of disease, delay or slowing of disease progression, amelioration or palliation of the disease state, and remission (whether partial or total), whether detectable or undetectable. In some embodiments, treating refers to prolonging survival as compared to expected survival if not receiving treatment. In some instances, treatment includes prophylaxis. Alternatively, treatment is "effective" if the progression of a disease is reduced or halted. In some embodiments, the term "treatment" also means prolonging survival as compared to expected survival if not receiving treatment. Those in need of treatment include those already diagnosed with a disease or condition, as well as those likely to develop a disease or condition due to genetic susceptibility or other factors which contribute to the disease or condition, such as a non-limiting example, weight, diet and health of a subject are factors which may contribute to a subject likely to develop diabetes mellitus. Those in need of treatment also include subjects in need of medical or surgical attention, care, or management. The subject is usually ill or injured, or at an increased risk of becoming ill relative to an average member of the population and in need of such attention, care, or management.

Without further elaboration, it is believed that one skilled in the art, using the preceding description, can utilize the present invention to the fullest extent. The following examples are illustrative only, and not limiting of the remainder of the disclosure in any way whatsoever.

EXAMPLES

These examples are provided for illustrative purposes only and not to limit the scope of the claims provided herein.

Example 1—Extraction of Cell Free DNA from Urine for Non-Invasive Diagnosis

Stabilization and Stock
Approvals

This project is approved by IRB of SYSU and Sichuan University. Informed consent is obtained from all patients. Tumor and normal tissues are obtained after patients signed an informed consent.

3 Steps: Urine Stable Buffer-Centrifuge—Supernatant Frozen

Urine Stable Buffer

Urine stable buffer is formulated urine DNA stabilization and cell free DNA protection. The preservative stabilizes cells in urine, preventing the release of genomic DNA, allowing isolation of high-quality cell-free DNA. Samples collected in urine stable buffer are stable for up to 14 days at room temperature, allowing convenient sample collection, transport, and storage.

Formulation of Urine Stable Buffer:
2.2% Sodium Citrate
0.8% Citric Acid
0.245% Dextrose
500 mMEGTA
1% glutaraldehyde or 1% Formaldehyde Centrifuge Urine samples are centrifuged at high speed (e.g., 11,000× g) for 15 min and the supernatant is use for nucleic acid extraction. This removes cellular material and cellular nucleic acids from the sample.

Stock

The supernatant is kept at −20 to −80° C. for long-term stock.

Procedure:

1. Transfer up to 40 ml urine into a conical tube.

2. Add 50 µl Urine stable Buffer for every 1 ml of urine. Mix the urine mixture well by inverse tube more than 10 times. After adding and mixing urine with Urine stable Buffer, urine can be stored up to 14 days at ambient temperature.

3. Centrifuge at 11000×g for 15 minutes.

4. Without disturbing the pellet, carefully transfer urine supernatant to a new conical tube.

5. The cell-free urine (urine supernatant) is then kept either at −20 to −80° C. as a stock or is processed for DNA extraction.

DNA Extraction

4 Steps: Lyse-Bind-Wash-Elute

Lysing Samples

Urine samples are lysed under highly denaturing conditions at elevated temperatures in the presence of proteinase K and DNA lysis Buffer, which together ensure inactivation of DNases and complete release of nucleic acids from bound proteins, lipids, and vesicles.

Binding DNA

The released nucleic acids from urine after lysed are selectively bound to the silica membrane column or beads.

Binding conditions are adjusted by adding Bing Buffer to allow optimal binding of the circulating nucleic acids to the silica membrane. Lysates are then transferred onto a silica membrane and circulating nucleic acids are absorbed from a large volume onto the small silica membrane as the lysate is drawn through by vacuum pressure.

Salt and pH conditions of Binding buffer ensure that proteins and other contaminants, which in some instances inhibit PCR and other downstream enzymatic reactions, are not retained on the silica membrane.

Washing

Nucleic acids remain bound to the membrane, while contaminants are efficiently washed away during 3 wash steps.

Elution of Pure Nucleic Acids

Highly pure circulating nucleic acids are eluted in Elution Buffer in single step.

Yield and Size of Nucleic Acids

Qubit ds DNA HS kit or quantitative amplification methods are used for determination of yields. The yield depends on the sample volume and the concentration of circulating nucleic acids in the sample. The absolute yield of circulating DNA and RNA obtained from a sample varies considerably between samples from different individuals and also depends on other factors, e.g., gender, certain disease states. The size distribution of circulating nucleic acids purified using this procedure is checked by agarose gel electrophoresis.

Example 2—Isolating Free Circulating Cell-Free DNA from Urine

Using QIAamp Circulating Nucleic Acid Kit from 4 ml urine, which are supernatant processed by urine stable buffer mix and centrifuged as descripted above. Urine samples are either fresh or frozen and then equilibrate to room temperature.

Procedure

1. Pipet 500 μl QIAGEN Proteinase K into a 50 ml tube (not provided).

2. Add 4 ml of urine into the 50 ml tube.

3. Add 4 ml of Buffer ACL (with carrier RNA as needed) and 1.0 ml Buffer ATL; close the cap and mix by pulse-vortexing for 30 s.

4. Incubate at 60° C. for 30 min.

5. Place the tube back on the lab bench and unscrew the cap.

6. Add 9.0 ml of Buffer ACB to the lysate, close the cap, and mix thoroughly by pulse-vortexing for 15-30 s.

7. Incubate the lysate-Buffer ACB mixture for 5 min on ice.

8. Insert the QIAamp Mini column into the VacConnector on the QIAvac 24 Plus. Insert a 20 ml tube extender into the open QIAamp Mini column. Make sure that the tube extender is firmly inserted into the QIAamp Mini column in order to avoid leakage of sample.

9. Carefully apply the lysate from step 7 into the tube extender of the QIAamp Mini column. Switch on the vacuum pump. When all lysates have been drawn through the columns completely, switch off the vacuum pump and release the pressure to 0 mbar. Carefully remove and discard the tube extender.

10. Apply 600 μl of Buffer ACW1 to the QIAamp Mini column. Leave the lid of the column open and switch on the vacuum pump. After all of Buffer ACW1 has been drawn through the QIAamp Mini column, switch off the vacuum pump and release the pressure to 0 mbar.

11. Apply 750 μl of Buffer ACW2 to the QIAamp Mini column. Leave the lid of the column open and switch on the vacuum pump. After all of Buffer ACW2 has been drawn through the QIAamp Mini column, switch off the vacuum pump and release the pressure to 0 mbar.

12. Apply 750 μl of ethanol (96-100%) to the QIAamp Mini column. Leave the lid of the column open and switch on the vacuum pump. After all of the ethanol has been drawn through the QIAamp Mini column, switch off the vacuum pump and release the pressure to 0 mbar.

13. Close the lid of the QIAamp Mini column, remove it from the vacuum manifold and discard the VacConnector. Place the QIAamp Mini column in a clean 2 ml collection tube (saved from step 8) and centrifuge at full speed (20,000×g; 14,000 rpm) for 3 min.

14. Place the QIAamp Mini column into a new 2 ml collection tube, open the lid, and incubate the assembly at 56° C. for 10 min to dry the membrane completely.

15. Place the QIAamp Mini column in a clean 1.5 ml elution tube and discard the collection tube from step 14. Carefully apply 20-150 μl of Buffer AVE to the center of the QIAamp Mini column membrane. Close the lid and incubate at room temperature for 3 min.

16. Centrifuge at full speed (20,000×g; 14,000 rpm) for 1 min to elute the nucleic acids.

Free-circulating cell-free DNA is eluted in Buffer AVE, ready for use in amplification reactions or storage at −15 to −30° C. Purified nucleic acids are free of proteins, nucleases, and other impurities. The isolated DNA is ideal for PCR, array, methylation detection, etc.

Example 3—Generation of Methylation Markers

Data Sources

DNA methylation data was obtained from various sources including The Cancer Genome Atlas (TCGA). The methylation status of 485,000 sites was generated using the Infinium 450K Methylation Array. Additional data was from the following GSE datasets: GSE46306, GSE50192, GSE58298 and GSE41826. Methylation profiles for tumors and their corresponding normal tissue were analyzed (Table 43).

The methylation data files were obtained in an DAT format with the ratio values of each bead that has been scanned. The minfi package from Bioconductor was used to convert these data files into a score that is called a Beta value.

After getting Beta values for all of the samples, any markers that did not exist across all 20 of the data sets were removed.

TABLE 43

Sample counts for each sample type from The Cancer Genome Atlas (TCGA)

| Cancer Type | Sample Count |
|---|---|
| Bladder cancer | 412 |
| Bladder normal | 21 |
| Brain normal | 145 |
| Breast cancer | 783 |
| Breast normal | 97 |
| Cholangiocarcinoma cancer | 36 |
| Cholangiocarcinoma normal | 9 |
| Colon cancer | 294 |
| Colon normal | 38 |
| Esophagus cancer | 185 |
| Esophagus normal | 16 |
| Glioblastoma multiforme (GBM) | 140 |
| Head and Neck cancer | 528 |
| Head and Neck normal | 50 |
| Kidney cancer | 659 |
| Kidney normal | 205 |
| Braine lower grade glioma (LGG) | 516 |
| Liver cancer | 376 |
| Liver normal | 50 |
| Lung caner | 839 |
| Lung normal | 74 |
| Pancreas cancer | 184 |
| Pancreas normal | 10 |
| Pheochromocytoma and Paraganglioma (PCPG) cancer | 179 |
| Pheochromocytoma and Paraganglioma (PCPG) normal | 3 |
| Prostate cancer | 501 |
| Prostate normal | 50 |
| Rectum cancer | 96 |
| Rectum normal | 7 |
| Sarcoma cancer | 261 |
| Sarcoma normal | 4 |
| Skin Cutaneous Melanoma (SKCM) cancer | 104 |
| Skin Cutaneous Melanoma (SKCM) normal | 2 |
| Stomach cancer | 393 |
| Stomach normal | 2 |
| Thyroid cancer | 507 |
| Thyroid normal | 56 |

Identify Top Markers in Each Comparison

Identification of a cancer type specific signature was achieved by comparing a pair-wise methylation difference between a particular cancer type versus its surrounding normal tissue, difference between two different cancer types, as well as difference between two different normal tissues. All of 485,000 CpG methylation sites were investigated in a training cohort of 1100 tumor samples and 231 matched adjacent-normal tissue samples.

Profile of each group to every other group was compared. With a total of 20 cancer groups listed above (Table 43), a total of 20*19/2=190 different group comparisons were performed. All of the 450 k markers were compared from one group to the other using the colttests( ) function in the R genefilter package. This analysis generated a p value with t-statistic and a difference in a mean methylation fraction between the categories for each marker in the comparison. After this comparison, the markers were sorted and ranked by the absolute value of the t-statistic to identify the markers that were most likely to be able to differentiate between the two categories. The top ten markers from each comparison were chosen for further validation analysis. With 190 comparison groups, 10×190=1900 markers were chosen for future analysis. After removing the duplicates, 958 unique markers were chosen for a pan-cancer panel which were tested in a validation cohort of 4000 tumor and 1000 normal tissues. This panel was then used to survey plasma and body fluid samples from lung, breast, liver, and colorectal cancer patients and controls without cancer to validate its diagnostic and prognostic values. Methylation patterns were correlated with expression gene expression profiles of markers in this panel.

Calculate Weights for Top Ten Markers in Each Comparison.

Principle Components analysis was applied to the top ten markers in each comparison group using the function in the stats environment: prcomp( ) and extracted the weights in the first principle component of each group and matched the weights with the ten corresponding markers in each group. There were 190 groupings of weights with markers.

Generate Variables 190 variables for each of the samples in the data were generated. Using the weight/marker combination, each variable V was calculated using the following equation:

$$V = \Sigma_{10}^{1}(W*M)$$

where W is the weight and M is the methylation Beta-value between 0 and 1 of the corresponding marker.

A matrix was generated where the dimensions are (1) the number of samples by (2) 190 variables.

Classify Samples

The above mentioned matrix was used to classify the samples. There are several classification algorithms that were used here including Logistic Regression, Nearest Neighbor (NN) and Support Vector Machines (SVM).

The kernlab library for R was used to generate the Support Vector Machines. The Crammer, Singer algorithm had slightly better results than the Weston, Watson algorithm. In the analysis, four potential types of classification errors were seen.

1. Wrong Tissue. This occurs when colon tissue is identified as lung tissue.
2. False negative
3. False positive
4. Right tissue and prognosis. Wrong cancer type. For example: This is when Kidney renal clear cell carcinoma is identified as Kidney renal papillary cell carcinoma.

Three methods were used to validate the results. The first two were verified with the last step.

1. The samples were divided into five equal parts and 4 of the parts were used for training and the fifth part was used to test the results.
2. Leave one out scenario was used where all of the samples were used for training except one. The one left out was used for testing. This was repeated for each sample until they had all been tested.
3. In the Two stage replication study, the samples were divided into two sets at the beginning of the process. With the training set, 10 markers in each comparison with the highest t-test scores were identified. These markers were then used to generate principal components and then used these variables to create a SVM. The obtained markers were then applied to the test set to generate principal components and SVM results.

With each of these methods, the prediction accuracy was above 95%. The number of tissue errors was less than 1%. Specificity was about 95% and sensitivity was almost 99% with the test dataset.

Figure 36:
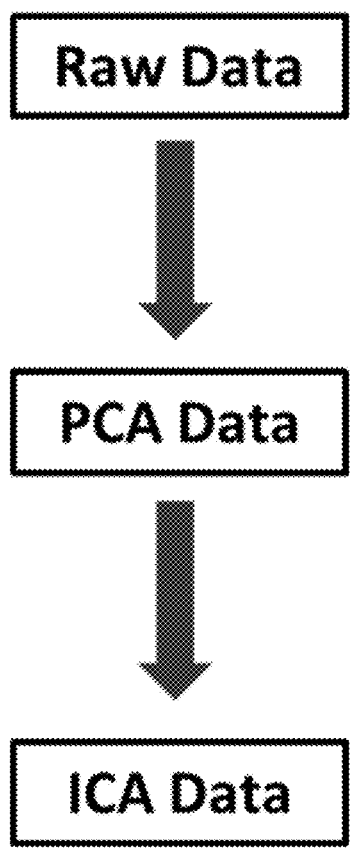
FIG. 36 illustrates an analysis method described herein utilizing PCA and ICA filtering.

In addition, PCA in combination with ICA was also applied. In ICA, the component processes were assumed to sum to the measured methylation values, without pre-specified noise terms, though some components were included or were represented as one or more types of 'noise' in the data. For example in this case, the number of variables (e.g., 117K methylation values) was much larger than the number of samples (e.g., 7706 samples). ICA decomposition performed without dimensionality reduction in some cases did not converge, since ICA needed a sufficient number of samples to learn the unmixing matrix from the input data. The steps are further illustrated in FIG. 36 and discussed below:

Unsupervised Learning—Part 1: Marker Selection

This part was to select the N most informative markers (e.g., N is 5000) from the total raw marker space (117K). This explored a cost-efficient and precise array of markers to sample the blood cell for sequential blood-sample categorization. Further modifications included enlarging the N value or duplicate the same set of markers (i.e., place each of 5000 markets in two different locations) to increase the signal-to-noise ratio (SNR) in blood-cell sampling.

Step 1: Independent Component Analysis (ICA)

The ICA found an 'unmixing' matrix W that linearly unmixed the input data matrix X (7176×117K) into a spatially independent source matrix U, where U=WX. The rows of estimated source matrix U (component activations) were the waveforms of the corresponding ICs along each of the markers. At this step, the ICA analysis returned 7176 components for further analysis. In ICA, the component processes are assumed to sum to the measured methylation values, without pre-specified noise terms, though some components may in fact include or represent one or more types of 'noise' in the data.

Step 2: Z-Transform Standardization to the Component Activation

In order to fairly assess the contribution of each marker among 7176 ICs, the Z-transform standardization to the component activations was applied. Specifically, each component activation (one row of U) removed its mean and divided the value by the standard deviation to have zero mean and unit variance. This procedure generated a normalized component activation U (i.e., marker weightings) in the so-called Z-values.

Step 3: Ranking the Z-Scored Marker for Each Component

This step was to identify the importance of the 117K markers to each of the 7176 components. For each component, all the markers according to the absolute Z-values were ranked so that each marker was tagged with a label from 1 to 117K. The marker labeled as "1" indicated the most contributed, whereas the marker labeled as "117K" was the least important. After this step, each marker was associated with 7176 values; each of them indicated the contribution to each of 7176 components.

Step 4: Retrieving Top-N Contributed Markers Among all Components

This step was to retrieve the N most important markers out of 117K. The search began with the collection of the marker labeled as "1" by any component, followed by the markers labeled as "2" by any components, and so on. The search ended with the desired number of contributed markers that had been completely collected.

Part 2: ICA-Based Feature Extraction

After selecting the most contributed markers (5000 from 117 K), ICA decomposition (described above) to the marker-trimmed matrix (7176×5000) to get the components treated as features was applied. Prior to the ICA decomposition, principal component analysis (PCA) was employed to reduce the dimension from 7176 to 25. Thus, the PCA and ICA at this step generated a feature matrix of 35 by 5000 for blood-sample classification.

Part 3: Blood-Sample Classification

After comparing the k-nearest neighbor (KNN) and support vector machine (SVM), the SVM, equipped with the kernel function of radial basis function (RBF), outperformed KNN and returned a classification performance of 93.99% to correctly recognize one of the 7176 samples from 30 classes (KNN=91.54%, where K=5).

As comparing the classification performance of 95.55% obtained using the entire raw markers (117K), the marker-trimmed matrix returned a comparable performance (93.99%).

DNA/RNA Isolation and Quantitative PCR

Characteristics of Patients and Tissues: Matched adjacent normal tissue was used as controls. These normal tissues were verified by histology without any evidence of cancer.

Tumor and corresponding far site samples were obtained from patients undergoing surgical tumor resection; samples were frozen and preserved in at −80° C. until use. Isolation of DNA and RNA from samples was performed using AllPrep DNA/RNA Mini kit (Qiagen, Valencia, Calif.), and RNA was subjected to on-column DNase digestion. RNA was quantified using a Nanodrop 2000 (Thermo Scientific), 200 ng RNA of each sample was used for complementary DNA synthesis using iScript cDNA synthesis kit (Bio-rad, Inc) according to the manufacturer's instructions. Briefly, samples were incubated for 5 min at 25° C., 30 min at 42° C., followed by incubation at 85° C. for 5 min. qPCR was performed by 40-cycle amplification using gene-specific primers and a Power SYBR Green PCR Master Mix on a 7500 Real Time PCR system (Applied Biosystems). Measurements were performed in triplicates and normalized to endogenous ACTB levels. Relative fold change in expression was calculated using the $\Delta\Delta CT$ method (cycle threshold values <30). Data are shown as mean±s.d. based on three replicates.

Genome Wide Methylation Profiling Identified Specific Methylation Signatures in Cancers To identify a cancer-type specific signature, methylation differences between a particular cancer type and its surrounding normal tissue, differences between different cancer types, as well as differences between two normal tissues in a pair-wise fashion were compared. A genome-wide DNA methylation profile of the training cohort of patients with twelve types of cancers, including two NSCLC subtypes of lung cancer (adenocarcinoma and squamous cell carcinoma) and colon and rectal cancers was analyzed using an Illumina 450,000 CpG methylation microarray. With a total of 21 tissue groups including 12 tumor groups and 9 normal tissue groups, a total of 21*20/2=210 unique pair-wise comparisons were performed. 450 k markers were compared from one group to another group using the colttests( ) function in the R genefilter package. Markers were ranked with the lowest p values by t-statistic and the largest difference in a mean methylation fraction between each comparison and the top ten markers in each group were selected for further validation analysis. After 190 comparisons, 958 unique, non-redundant markers were generated as a pan-cancer panel. Each marker was weighted by applying Principle Components analysis to the top ten markers in each comparison group using the function in the stats environment: prcomp( ) and extracted the weights in the first principle component of each group and matched the weights with the ten corresponding markers in each group. These markers were used to classify the samples with several algorithms including Neural networks, Logistic Regression, Nearest Neighbor (NN) and Support Vector Machines (SVM), all of which generated consistent results. Analyses using SVM were found to be most robust and were therefore used in all subsequent analyses. These 958 top-ranked CpG sites were plotted in an unsupervised fashion in the cancer and normal samples.

The hierarchical clustering was able to distinguish cancer type with high specificity and sensitivity. Given that identifying the presence and site of a cancer would most likely provide maximal clinical utility, cancers arising from the same tissue were combined for the purpose of evaluating the effectiveness of the algorithm. Combined tumors included colon and rectal cancers, lung squamous cell and adenocarcinoma, renal papillary and clear cell carcinoma, and low-grade glioma and glioblastoma multiforme. The algorithm was largely effective in distinguishing cancers arising from the same tissue, except for colon and rectal cancer, which likely reflects the similar biology in these tumors. The training cohort consisted of 2852 cancer samples and 1278 normals. 4087 of 4130 or 98.9% of samples were identified correctly as cancer or normal. Only 2 of the cancer samples were identified correctly as cancer but as the wrong tissue. Overall sensitivity for cancer was 99.5% and was consistent between individual cancers, while specificity was 97.8%, with more variation between tissue types. In particular, both prostate and thyroid had low specificities of 74.1% and 75% respectively, possibly reflecting limitations in the algorithm, low samples numbers available for training, or the high prevalence of indolent malignancy in these tissues. The ability of the algorithm to identify cancers was validated in an independent cohort consisting of 1220 cancer and 550 normal samples. Similar results were achieved in this cohort, with 98.7% of samples identified correctly as cancer or normal and only 4 cancer samples identified as the wrong tissue. Overall sensitivity and specificity in the validation cohort was 98.9% and 98.4% respectively, with very similar prediction characteristics as in the training cohort. Overall, these results demonstrate the robust nature of these methylation patterns in identifying the presence of malignancy as well as its site of origin.

A Cancer Methylation Profile Correlated with its Gene Expression Pattern

Given that DNA methylation is an essential epigenetic regulator of gene expression, the correlation of differential methylation of sites genes in tumor versus normal tissue with gene expression in the cohort was investigated. Specifically, those methylation sites that predicted the presence of malignancy in the above algorithm were of interest. Top markers which showed hypermethylation in a cancer type when comparing to that of its matched normal tissue counterpart were selected and identified their corresponding genes in breast, liver, lung, and colon cancers. RNA seq data from TCGA was utilized as a discovery cohort to calculate differential expression of these genes and the cancer tissue collection was used as the validation cohort. Almost every gene selected exhibited marked CpG hypermethylation relative to normal, and decreased expression was observed in each of these genes. A p-value of $1.21 \times 10^{-21}$ was determined using a Wilcoxon sign-rank test. In some instances, the selected genes associate with carcinogenesis.

A Pan-Cancer Panel for Early Cancer Diagnosis

After validation of 8000 methylation markers and their validation in a second cohort of cancer patients, their use to detect early cancer was explored by surveying cell-free tumor DNA in the plasma and urine.

Example 4—Pan-Cancer Methylation Markers in Diagnosis and Prognosis of Common Cancers Approvals The Cancer Genome Atlas (TCGA) data were downloaded from the TCGA website. This project was approved by the IRB of SYSU and Sichuan University. Informed consent was obtained from all patients. Tumor and normal tissues were obtained after patients signed an informed consent.

Data Sources

DNA methylation data from initial training set and first testing set were obtained from The Cancer Genome Atlas (TCGA). Clinical characteristics and molecular profiling including methylation data for a training cohort of 3852 tumor and matched adjacent-normal tissue samples as well as a validation cohort of 1150 patients tumor and matched normal samples were obtained from the TCGA. A separate validation cohort of 760 Chinese patients with cancer was obtained using a bisulfite sequencing method from the West China Hospital and Sun Yat-sen University Cancer Center. Clinical characteristics of the 5762 patients in study cohorts are listed in Table 44. Matched adjacent-normal tissue samples were collected simultaneously with tumor from the same patient and were verified by histology to have no evidence of cancer. The methylation status of 485,000 sites was generated using the Infinium 450K Methylation Array. Additional data was from the following GSE datasets: GSE46306, GSE50192, GSE58298 and GSE41826. The methylation data files were obtained in an DAT format with the ratio values of each bead that has been scanned. The minfi package from Bioconductor was used to convert these data files into a score, referred to as a Beta value. After obtaining Beta values for all of the samples, any markers that did not exist across all 20 of the datasets were excluded.

TABLE 44

Characteristics of cancer cohorts

| | training | testing1 | testing2 | total |
|---|---|---|---|---|
| cancer_brain | 649 | 195 | 0 | 844 |
| nomal_brain | 150 | 44 | 0 | 194 |
| cancer_breast | 790 | 225 | 73 | 1088 |
| nomal_breast | 97 | 23 | 45 | 165 |
| cancer_colon/rectal | 306 | 124 | 194 | 624 |
| nomal_colon/rectal | 38 | 12 | 164 | 214 |
| cancer_kidney | 597 | 164 | 32 | 793 |
| nomal_kidney | 205 | 54 | 38 | 297 |
| cancer_liver | 238 | 70 | 48 | 356 |
| nomal_liver | 50 | 17 | 73 | 140 |
| cancer_lung | 838 | 199 | 47 | 1084 |
| nomal_lung | 74 | 23 | 46 | 143 |
| total | 4032 | 1150 | 760 | 5942 |

Generating a Pan-Cancer Marker Set

Figure 8:
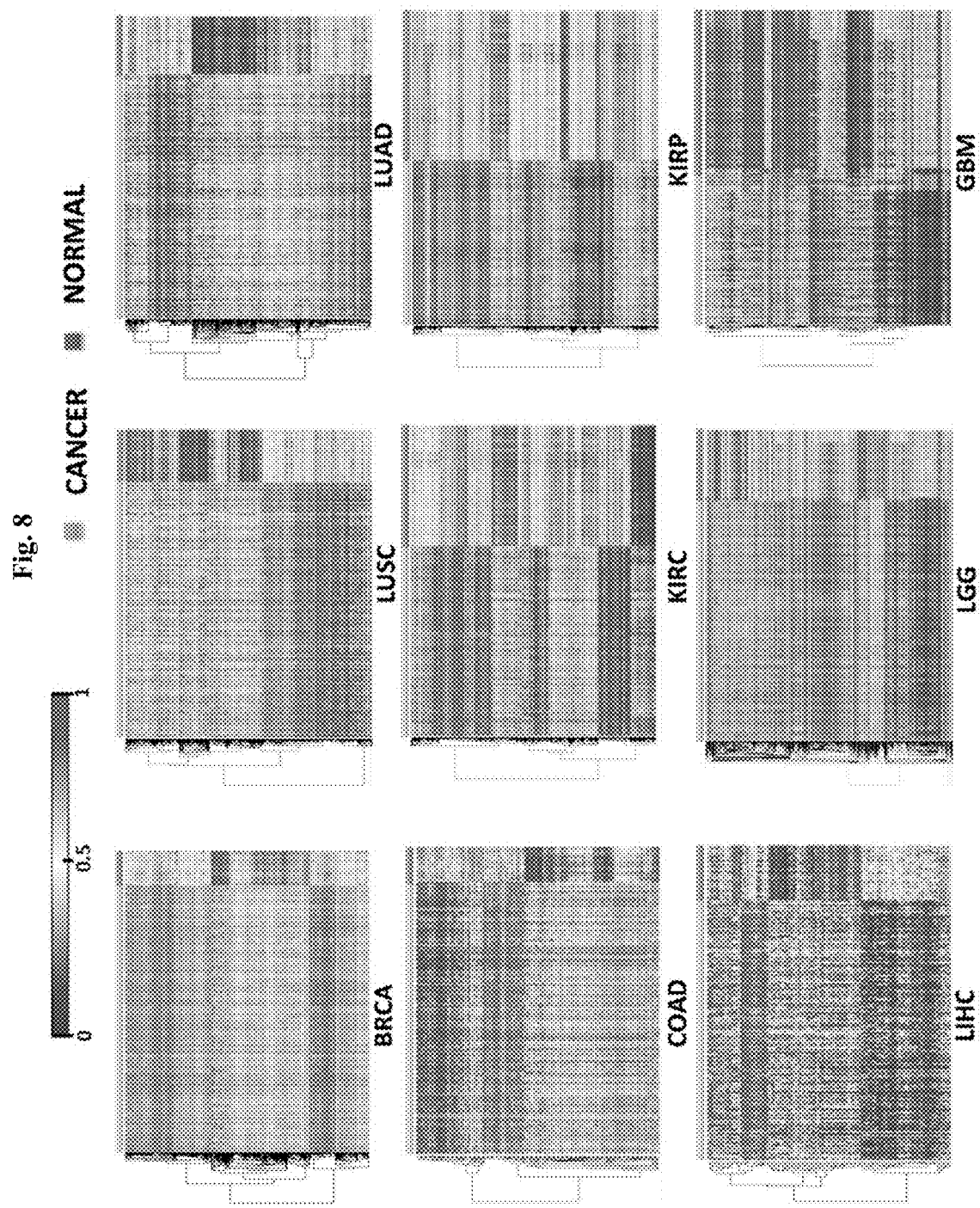
FIG. 8 illustrates unsupervised hierarchical clustering and heat maps associated with the methylation profile in different cancer types.

Cancer type specific signature was identified by comparing the pair-wise methylation difference between a particular cancer type versus its corresponding normal tissue, the difference between two different cancer types, as well as difference between two different normal tissues, with a total of 12 tissue groups including 6 tumor groups and 6 normal tissue groups. Patient samples were randomly divided from the TCGA representing 9 cancer types from 6 different tissues with matched adjacent-normal tissue into training and validation cohorts. To do this, a total of $12*11/2=66$ unique pair-wise comparisons were performed. Using an Illumina 450,000 CpG methylation microarray, 450 k markers were compared from one group to another group using the [column t test] colttests( ) function in the R genefilter package. Markers with the lowest p values by t-statistic and the largest difference in a mean methylation fraction between each comparison were ranked and the top ten markers in each group were selected for further validation analysis. After 450 comparisons, 432 unique, non-redundant markers were generated as a pan-cancer panel. These 432 top-ranked CpG sites were plotted in an unsupervised fashion for each cancer type and normal samples (FIG. 8).

Hierarchal clustering of these samples according to differential methylation of CpG sites in this fashion was able to distinguish cancer tissue of origin as well as from normal tissue in the TCGA training cohort (Table 45). Overall sensitivity was 99.3% and specificity was 98.5%. These markers were then applied to a TCGA validation cohort (Table 46), with a similar sensitivity of 98.5% and somewhat decreased overall specificity of 94.8%. Normal liver in particular had only 82.4% specificity in this validation cohort, although potentially limited by numbers. The results were also confirmed in an independent third cohort of Chinese cancer patients (Table 47), with methylation analysis performed using an alternative bisulfite sequencing technique in a distinct ethnic and geographic background from the TCGA (adequate numbers of low-grade gliomas (LGG) and glioblastoma multiforme (GBM) were not available in the Chinese cohort). The methylation analysis had an overall sensitivity of 93.7% and specificity of 96.7% in this cohort, with breast and lung distinguished slightly less well in this cohort compared with TCGA. Overall, these results demonstrate the robust nature of these methylation patterns in identifying the presence of malignancy as well as its site of origin.

TABLE 45

TCGA Training Cohort

| Training Cohort | Brain Ca | Breast Ca | Colon Ca | Kidney Ca | Liver Ca | Lung Ca | Normal Brain | Normal Breast | Normal Colon | Normal Kidney | Normal Liver | Normal Lung | |
|---|---|---|---|---|---|---|---|---|---|---|---|---|---|
| Brain Ca | 647 | | | | | | 4 | | | | | | |
| Breast Ca | | 783 | | | | | | 3 | | | | | |
| Colon Ca | | | 306 | | | | | | | | | | |
| Kidney Ca | | | | 597 | | | | | | | | | |
| Liver Ca | | | | | 235 | | | | | | 1 | | |
| Lung Ca | | | | | | 827 | | | | | | 1 | |
| Normal Brain | 2 | | | | | | 146 | | | | | | |
| Normal Breast | | 7 | | | | | | 94 | | | | | |
| Normal Colon | | | | | | | | | 38 | | | | |
| Normal Kidney | | | | 0 | | | | | | 205 | | | |
| Normal Liver | | | | | 3 | | | | | | 49 | | |
| Normal Lung | | | | | | 5 | | | | | | 73 | Totals |
| Totals | 649 | 790 | 306 | 597 | 238 | 838 | 150 | 97 | 38 | 205 | 50 | 74 | 4032 |
| Correct | 647 | 783 | 306 | 597 | 235 | 827 | 146 | 94 | 38 | 205 | 49 | 73 | 4000 |
| False Positive | | | | | | | 4 | 3 | | | 1 | 1 | 9 |
| False Negative | 2 | 7 | | | 3 | 11 | | | | | | | 17 |
| Wrong Tissue | | | | | | 6 | | | | | | | 6 |
| Correct (%) | 99.7 | 99.1 | 100 | 100 | 98.7 | 98.7 | 97.3 | 96.9 | 100 | 100 | 98 | 98.6 | 99.2 |

TABLE 46

TCGA Test Cohort

| Training Cohort 1 | Brain Ca | Breast Ca | Colon Ca | Kidney Ca | Liver Ca | Lung Ca | Normal Brain | Normal Breast | Normal Colon | Normal Kidney | Normal Liver | Normal Lung | |
|---|---|---|---|---|---|---|---|---|---|---|---|---|---|
| Brain Ca | 193 | | | | | | 2 | | | | | | |
| Breast Ca | | 223 | | | | | | 2 | | | | | |
| Colon Ca | | | 124 | | | | | | | | | | |
| Kidney Ca | | | | 162 | | | | | | | | | |
| Liver Ca | | | | | 67 | 1 | | | | | 3 | | |
| Lung Ca | | 1 | | 1 | | 193 | | | | | | 2 | |
| Normal Brain | 2 | | | | | | 42 | | | | | | |
| Normal Breast | | 1 | | | | | | 21 | | | | | |
| Normal Colon | | | | | | | | | 12 | | | | |
| Normal Kidney | | | | 1 | | | | | | 54 | | | |
| Normal Liver | | | | | 2 | | | | | | 14 | | |
| Normal Lung | | | | | | 1 | | | | | | 21 | Totals |
| Totals | 195 | 225 | 124 | 164 | 70 | 199 | 44 | 23 | 12 | 54 | 17 | 23 | 1150 |
| Correct | 193 | 223 | 124 | 162 | 67 | 193 | 42 | 21 | 12 | 54 | 14 | 21 | 1126 |
| False Positive | | | | | | | 2 | 2 | | | 3 | 2 | 9 |
| False Negative | 2 | 1 | | 1 | 2 | 1 | | | | | | | 7 |
| Wrong Tissue | | 1 | | 1 | 1 | 5 | | | | | | | 8 |
| Correct (%) | 99 | 99 | 100 | 98.9 | 95.7 | 97 | 95.5 | 91.3 | 100 | 100 | 82.4 | 91.3 | 97.9 |

TABLE 47

Chinese Test Cohort

| Testing Cohort 2 | Breast Ca | Colon/rectum Ca | Kidney Ca | Liver Ca | Lung Ca | Normal Breast | Normal Colon | Normal Kidney | Normal Liver | Normal Lung |  |
|---|---|---|---|---|---|---|---|---|---|---|---|
| Breast Ca | 63 | | | | | 4 | | | | 1 | |
| Colon/rectum Ca | 1 | 184 | | | 1 | | | | | | |
| Kidney Ca | | 1 | 32 | | | | | 2 | | | |
| Liver Ca | | | | 45 | 1 | | | | | 3 | |
| Lung Ca | | | 2 | | 42 | | | | | 1 | |
| Normal Breast | 7 | | | | | 41 | | | | | |
| Normal Colon | | 6 | | | | | 164 | | | | |
| Normal Kidney | | | | | | | | 36 | | | |
| Normal Liver | | 2 | | 2 | | | | | 72 | | |
| Normal Lung | | 1 | | | 1 | | | | | 44 | Totals |
| Totals | 73 | 194 | 32 | 48 | 47 | 45 | 164 | 38 | 73 | 46 | 760 |
| Correct | 65 | 184 | 32 | 45 | 43 | 41 | 164 | 36 | 72 | 41 | 723 |
| False Positive | | | | | | 4 | | 2 | 1 | 1 | 8 |
| False Negative | 7 | 9 | | 2 | 1 | | | | | | 19 |
| Wrong Tissue | 1 | 1 | | 1 | 3 | | | | | 4 | 10 |
| Correct (%) | 89.0 | 94.8 | 100 | 93.8 | 91.5 | 91.1 | 100 | 94.7 | 98.6 | 89.1 | 95.1 |

Figure 9A:
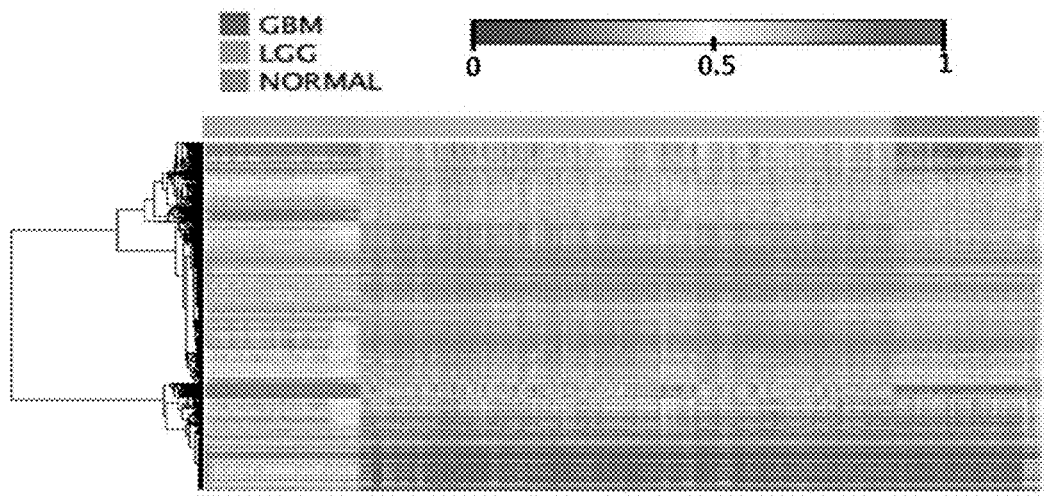
FIG. 9A-FIG. 9C illustrate methylation profiles which are utilized to differentiate different types of cancers within the same tissue type using unsupervised hierarchical clustering and heat maps associated with reference methylation profiles in different cancer types. The heat map as illustrated in FIG. 9A is obtained from 511 LGG, 138 GBM and 150 normal brain tissue samples based on the 1409 markers. The heat map as illustrated in FIG. 9B is obtained from 311 LUAD, 359 LUSC and 74 normal lung tissue samples based on the 926 markers. The heat map as illustrated in FIG. 9C is obtained from 321 KIRC, 226 KIRP and 205 normal kidney tissue samples based on the 716 markers.
Figure 9B:
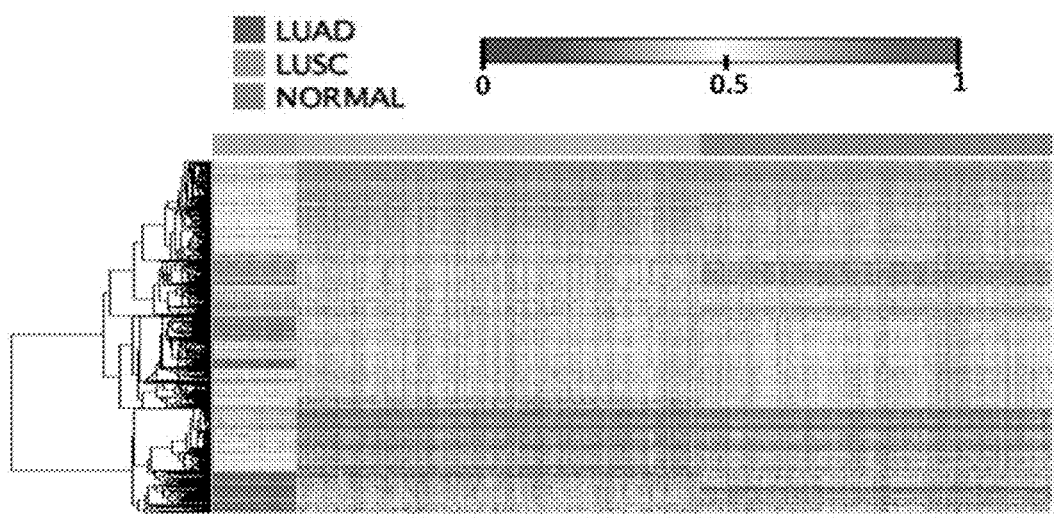
Figure 9C:
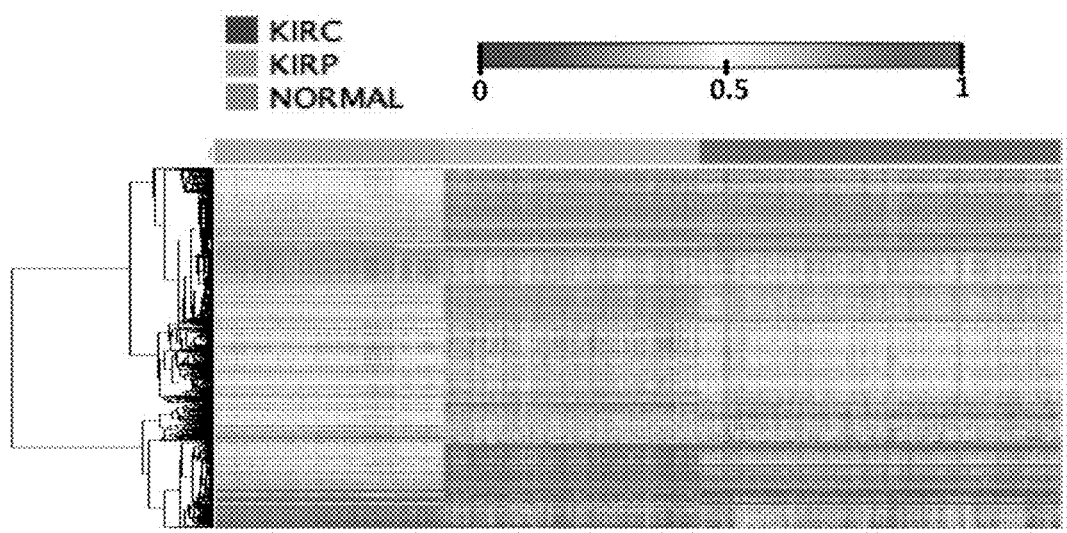

The algorithm distinguished between the tissue origin of a malignancy and cancers arising from the same tissue. Histological subtypes are involved in therapy selection and prognosis. Thus, the ability of the algorithm to distinguish histologic subtype from a common tissue of origin was further explored for low-grade gliomas (LGG) versus glioblastoma multiforme (GBM) (FIG. 9A, Table 48), lung adenocarcinoma (LUAD) versus squamous cell carcinoma (LUSC) (FIG. 9B, Table 49), and kidney renal clear cell (KIRC) versus kidney renal papillary cell carcinoma (KIRP) (FIG. 9C, Table 50). Heat maps exemplifying unsupervised hierarchical clustering of histological subtypes are plotted in FIG. 9 and the results of classification based on methylation are shown in Tables 48-50. These methylation signatures were able to correctly identify the histologic subtype in 97.6% of brain cancers, 95.2% of lung cancers, and 97.2% of kidney cancers in the TCGA cohort. The large majority of incorrect classifications correctly identified cancer but the wrong histological subtype; fewer than 1% of samples were misidentified as normal tissue.

TABLE 48

Brain Tumor Cohort

| Brain Tumor Cohort | Glioblastoma | Low-grade Gliomas | Normal Brain | Totals |
|---|---|---|---|---|
| Glioblastoma | 129 | 6 | 0 | |
| Low-grade Gliomas | 7 | 505 | 4 | |
| Normal Brain | 2 | 0 | 146 | |
| Totals | 138 | 511 | 150 | 798 |
| Correct | 129 | 505 | 146 | 780 |
| Close | 7 | 6 | 0 | 13 |
| False Positive | 0 | 0 | 4 | 4 |
| False Negative | 2 | 0 | 0 | 2 |
| Wrong Tissue | 0 | 0 | 0 | 0 |
| Specificity (%) | | | 97.3 | 97.3 |
| Sensitivity (%) | 93.5 | 98.8 | | 97.7 |

TABLE 49

Lung Cancer Cohort

| Lung Cancer Cohort | LUAD | LUSC | Normal Lung | Totals |
|---|---|---|---|---|
| LUAD | 458 | 22 | 0 | |
| LUSC | 8 | 340 | 1 | |
| Normal Lung | 3 | 2 | 73 | |
| Totals | 469 | 369 | 74 | 912 |
| Correct | 458 | 340 | 73 | 871 |
| Close | 8 | 22 | 0 | 30 |
| False Positive | 0 | 0 | 1 | 1 |
| False Negative | 3 | 2 | 0 | 5 |
| Wrong Tissue | 0 | 5 | 0 | 5 |
| Correct (%) | 97.7 | 92.1 | 98.6 | 95.5 |

TABLE 50

Kidney Tumor Cohort

| Kidney Tumor Cohort | KIRC | KIRP | Normal Kidney | Totals |
|---|---|---|---|---|
| KIRC | 314 | 8 | 0 | |
| KRIP | 8 | 267 | 0 | |
| Normal Kidney | 0 | 0 | 205 | |
| Totals | 322 | 275 | 205 | 802 |
| Correct | 313 | 267 | 205 | 785 |
| Close | 8 | 8 | 0 | 16 |
| False Positive | 0 | 0 | 0 | 0 |
| False Negative | 0 | 0 | 0 | 0 |
| Wrong Tissue | 0 | 0 | 0 | 16 |
| Specificity (%) | | | 100 | 100 |
| Sensitivity (%) | 97.2 | 97.1 | | 97.1 |

Calculate Weights for Top Ten Markers in Each Comparison.

The Principle Component analysis was applied to the top ten markers in each comparison group using the function in the stats environment: prcomp( ) and the weights in the first principle component of each group were extracted and matched with the ten corresponding markers in each group. There were 45 groupings of weights with markers. These markers were used to classify the samples with several algorithms including Neural Networks, Logistic Regression, Nearest Neighbor (NN) and Support Vector Machines (SVM), all of which generated consistent results. Analyses using SVM were found to be most robust and were therefore used in all subsequent analyses.

Figure 10A:
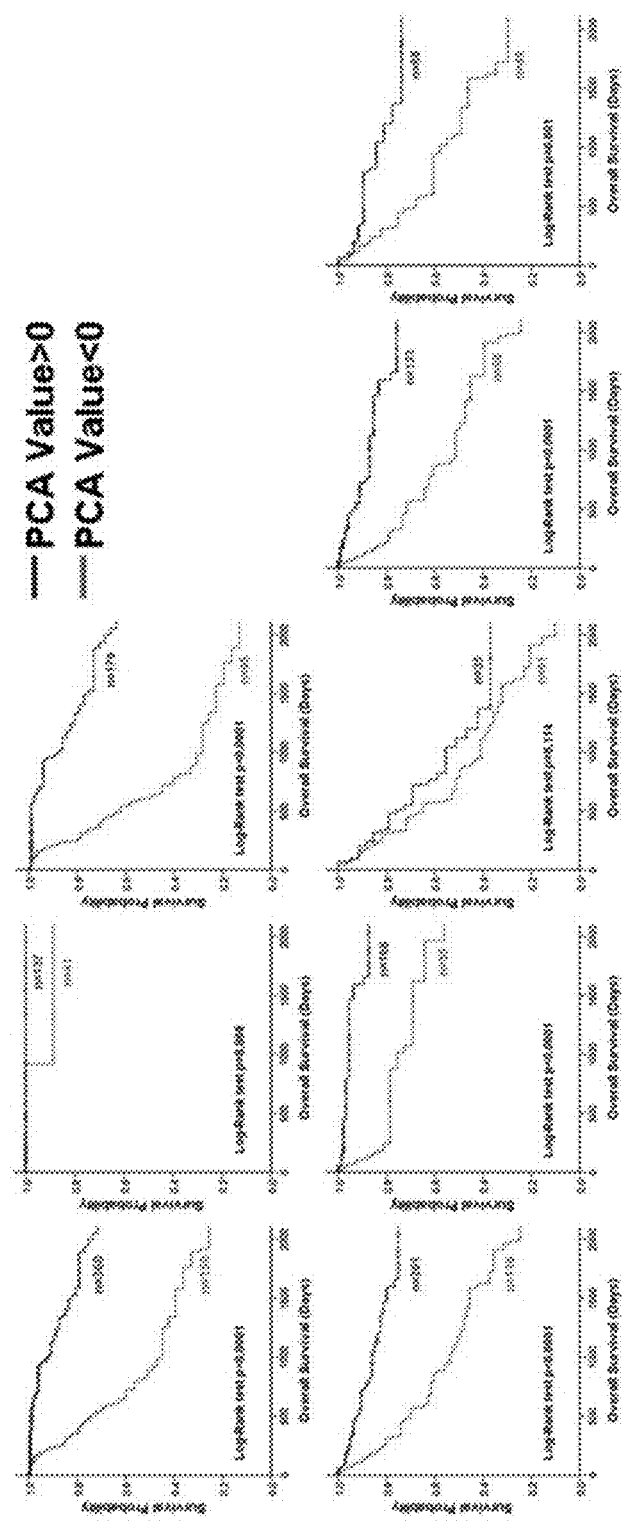
FIG. 10A-FIG. 10B illustrate graphs that exemplify methylation markers which are utilized to predict overall survival of patients with different types of cancers including: LGG, KIRP, KIRC, LUSC and LUAD, as well as stratified according to the tumor status and tumor stage.
Figure 10B:
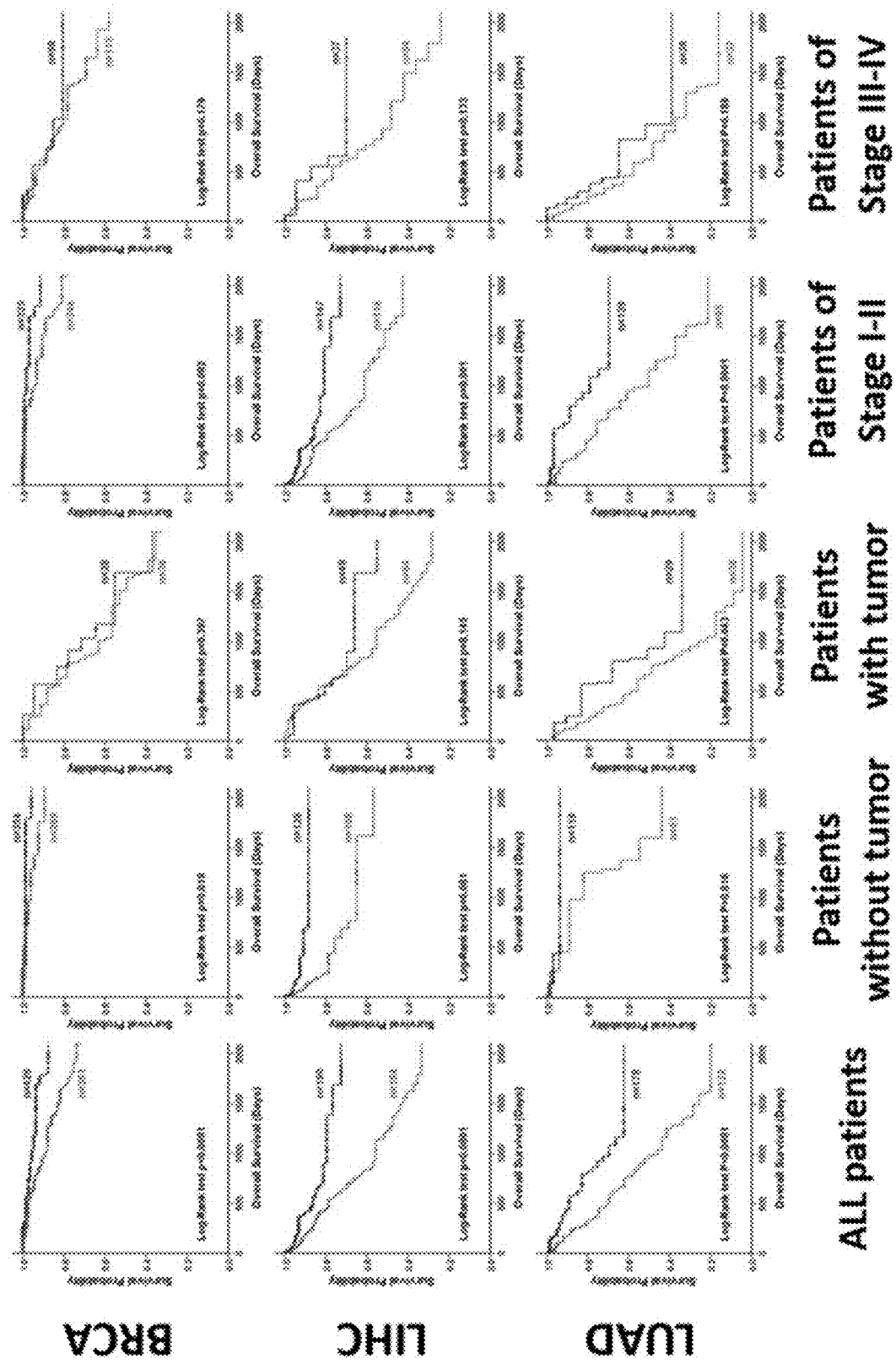

For each tumor type, samples were divided into two groups based on the resulting methylation signatures and their survival was plotted using Kaplan-Meier curves (FIG. 10). Subgroups based on tumor stage and the presence of residual tumor following treatment was also analyzed. These methylation profiles were able to predict highly statistically significant differences in survival in all tumor types and most subgroups examined. Several specific results stood as potentially clinically significant. In all LGG patients as well as patients with residual tumor, methylation identified a subgroup of individuals with particularly favorable survival (FIG. 10, P<0.001). In kidney renal clear cell carcinoma (KIRC), analysis identified a small subgroup of patients with relatively poor survival compared with a group with relatively better survival in patients without residual tumor after treatment (86.3% vs 34.8%) (FIG. 10). In KIRP, the algorithm identified patients with especially poor prognosis in subgroups of patients with residual tumor after treatment or with advanced stage disease (FIG. 10). Although statistically significant, estimation of the magnitude of this effect is limited by low numbers in these groups. A subgroup of LUAD patients with no residual tumor after treatment was further identified with a particularly favorable prognosis compared with most patients (FIG. 10), suggesting a low rate of recurrence in these patients. Finally, in LUSC, methylation patterns predicted similarly superior survival in a subset of patients without residual tumor after treatment (FIG. 10). These results highlight the possibility of using methylation patterns to complement histology in predicting survival and, in several examples above, identifying groups of patients that may require more or less aggressive monitoring or treatment.

Figure 11A:
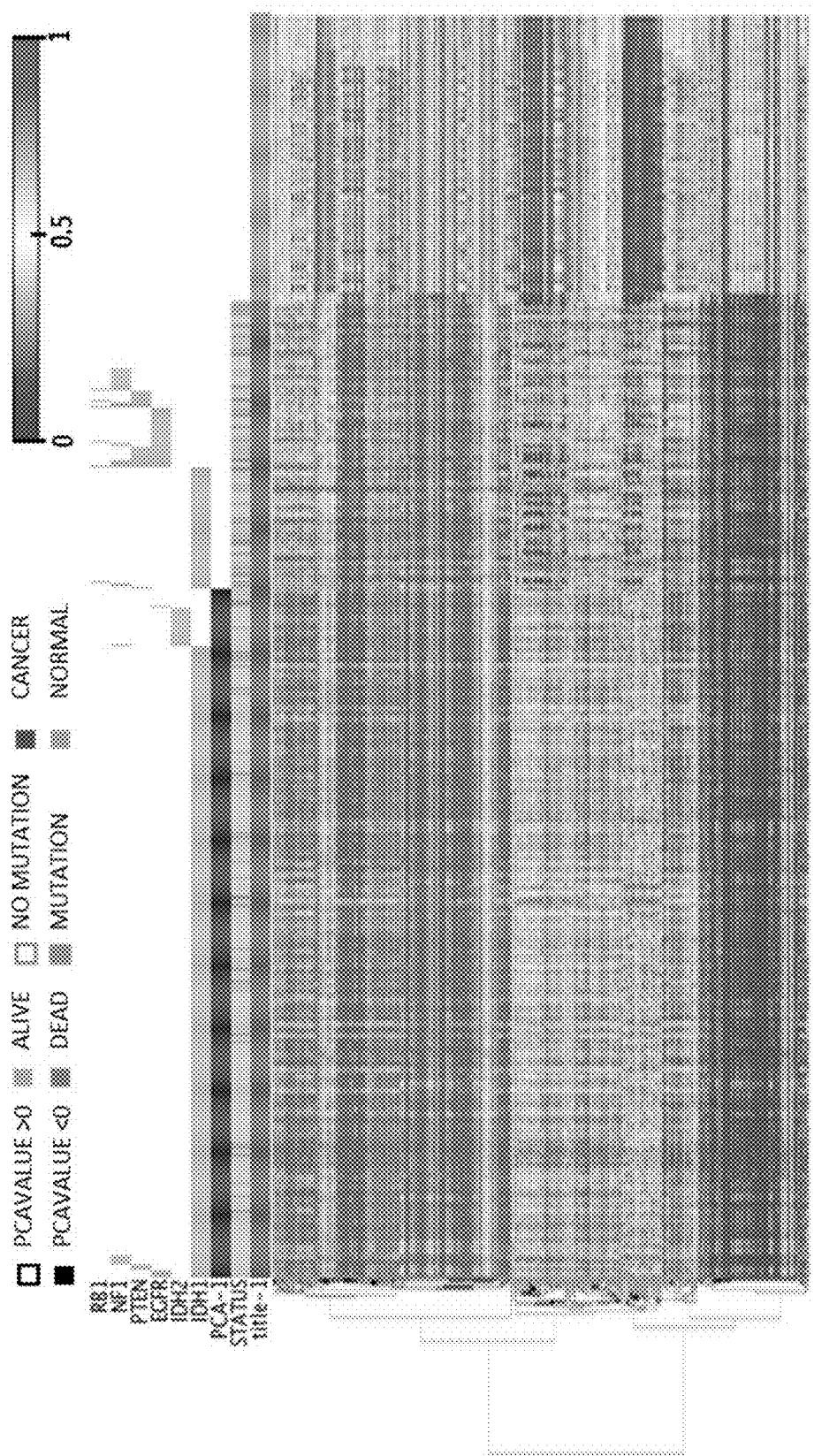
FIG. 11A-FIG. 11D illustrate methylation based survival classification is correlated with driver mutation status.
Figure 11B:
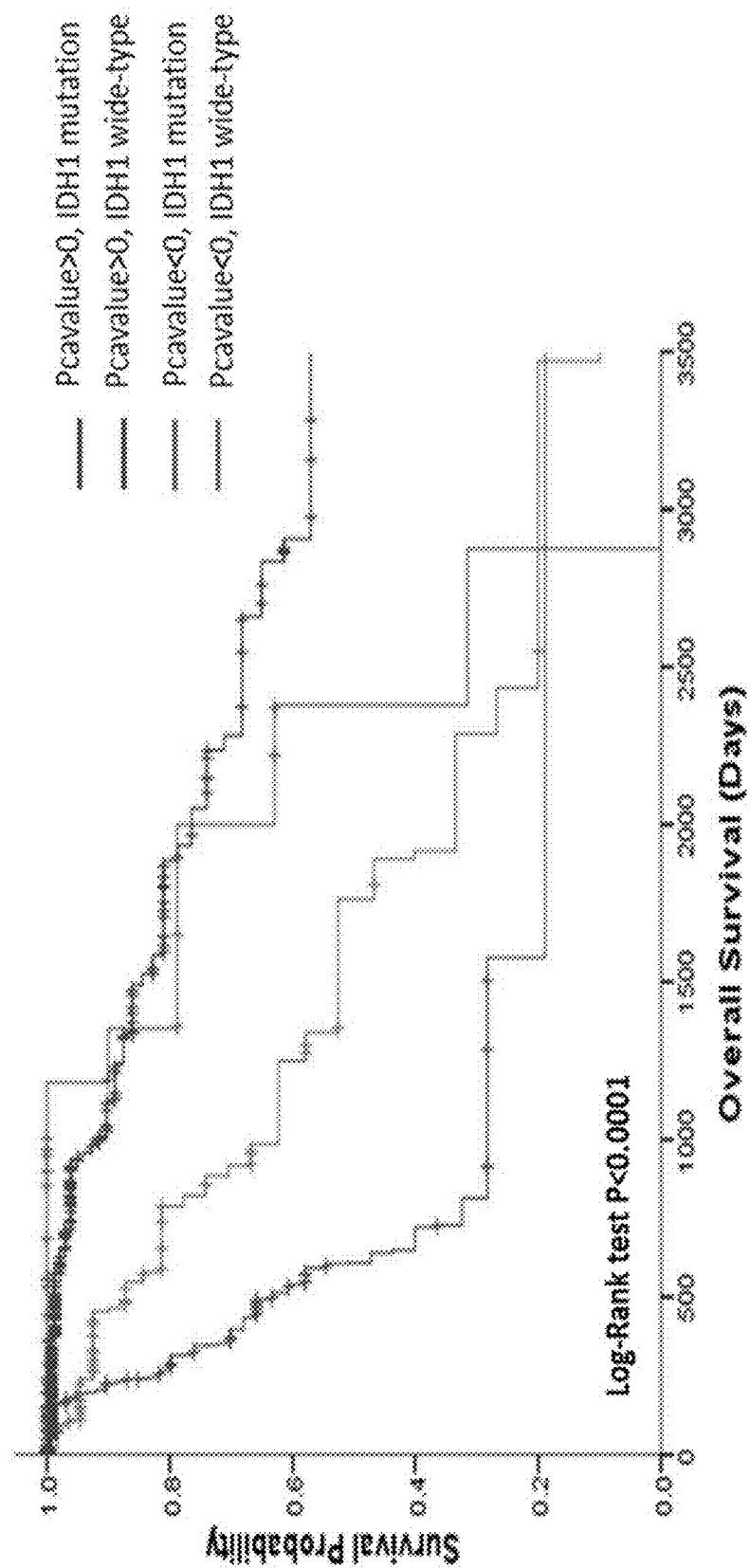

Experiments were carried out to test whether somatic mutations added additional prognostic information to methylation signature alone, or whether methylation signature correlated with somatic mutations. For LGG, mutations in either IDH1 or IDH2 were common and mutually exclusive, with mutations occur more frequently in IDH1 than in IDH2. IDH1 or IDH2 mutations were present in 98% of samples with the methylation signature predictive of improved prognosis versus only 67% in the methylation signature predictive of poor prognosis (FIG. 11A). Interestingly, IDH2 mutations were not observed at all in the group with methylation signature predictive of poor prognosis. Uniquely among somatic mutations for the tumor type, IDH1/IDH2 status independently predicted improved prognosis in addition to methylation signature (FIG. 11B). Although IDH1 and a positive methylation signature predicted excellent prognosis, IDH2 mutations appeared to predict even better survival. No deaths were observed in IDH2 mutants in the sample set, although this observation is limited by a sample size of 22. IDH1 and IDH2 mutations are known to be common in LGG and are predictive of good prognosis in this tumor, with LGG lacking IDH1/2 mutations demonstrating clinical behavior more similar to GBM. IDH1 and IDH2 are involved in metabolic processes in the cell; mutations in these genes are thought to interfere with hydroxylation and demethylation of mCpG sites. Notably, methylations signature predictive of prognosis was associated neither with somatic mutations nor histologic markers including HER2 and ER/PR expression.

Figure 11C:
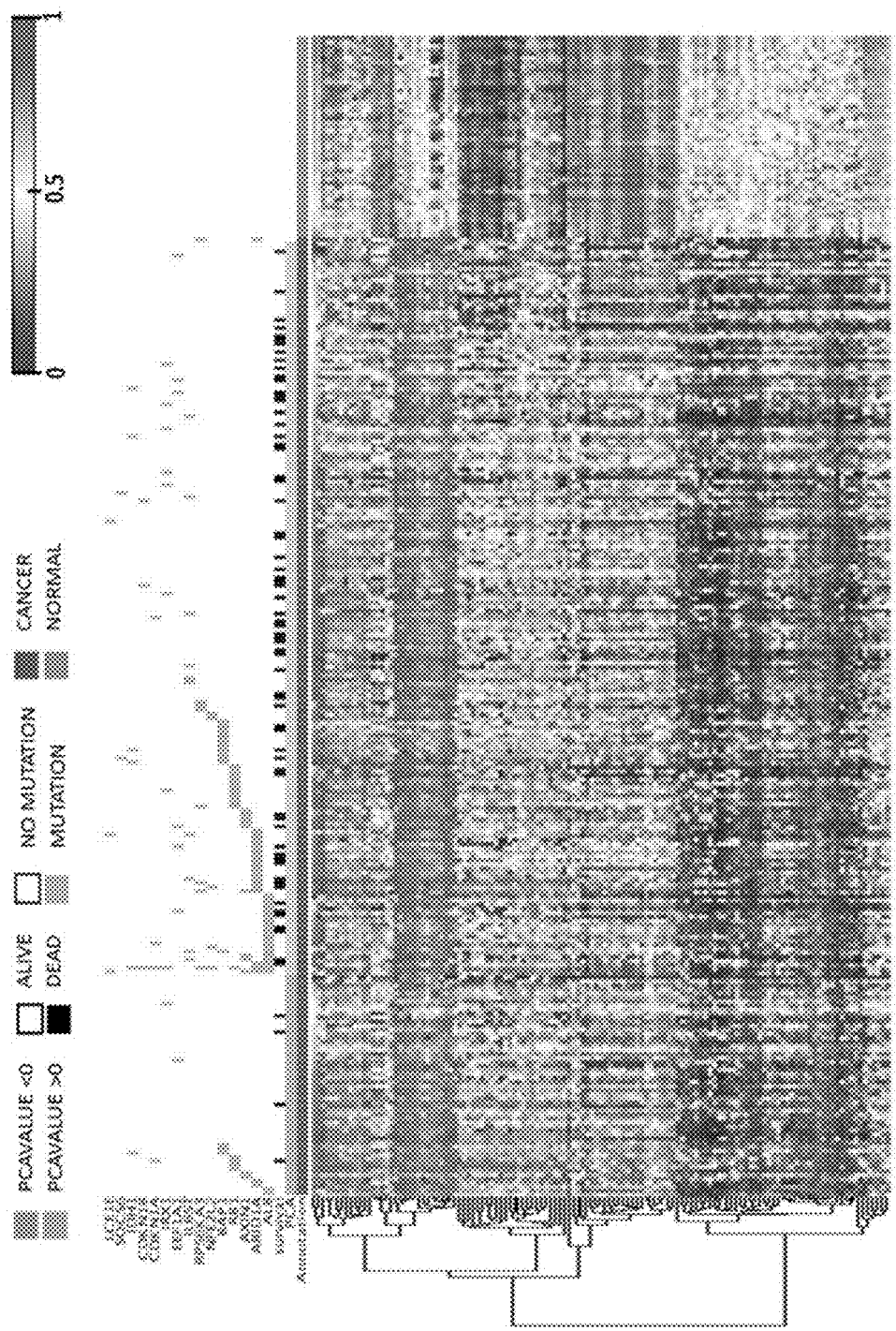
Figure 11D:
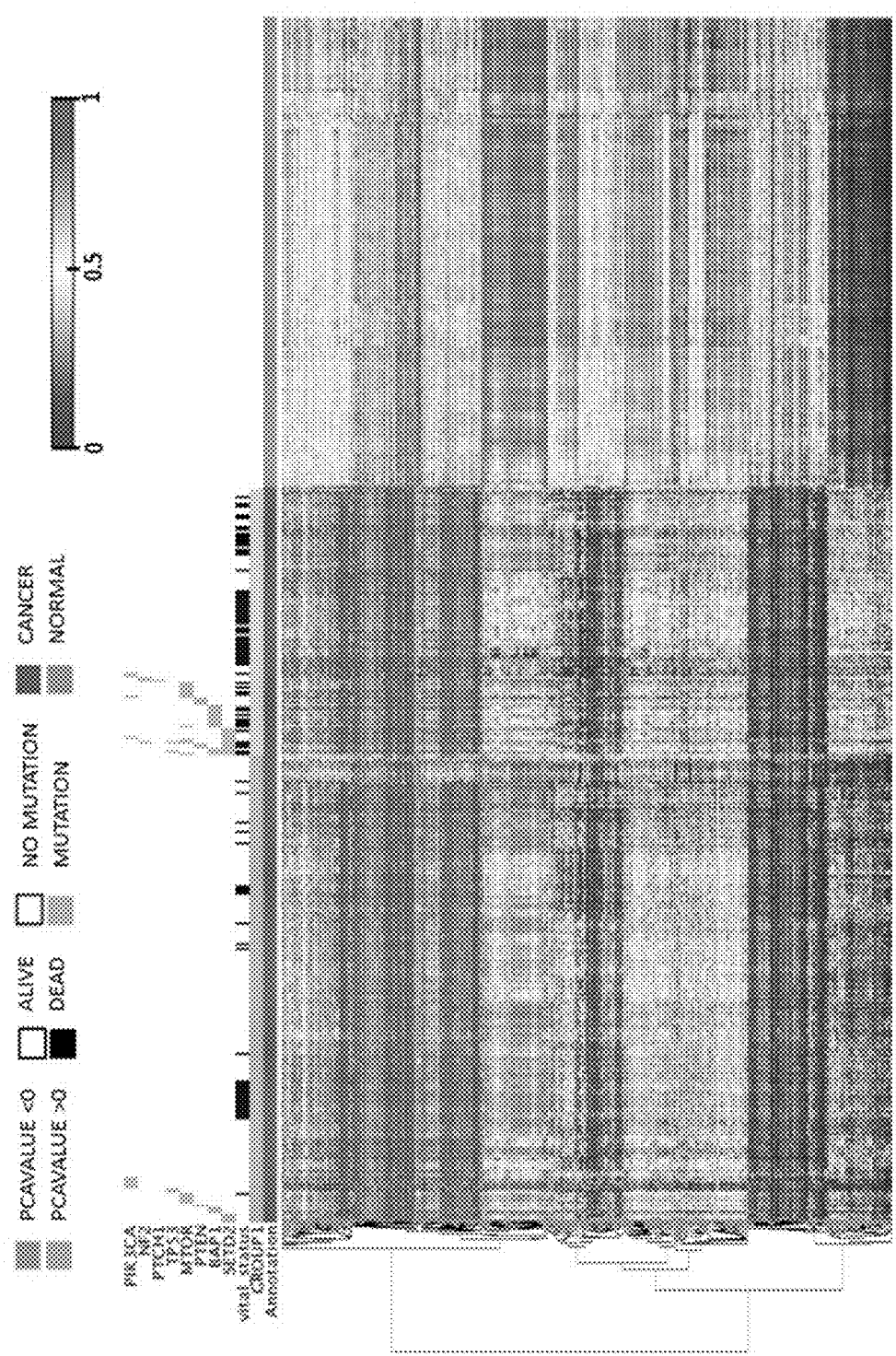
Figure 12:
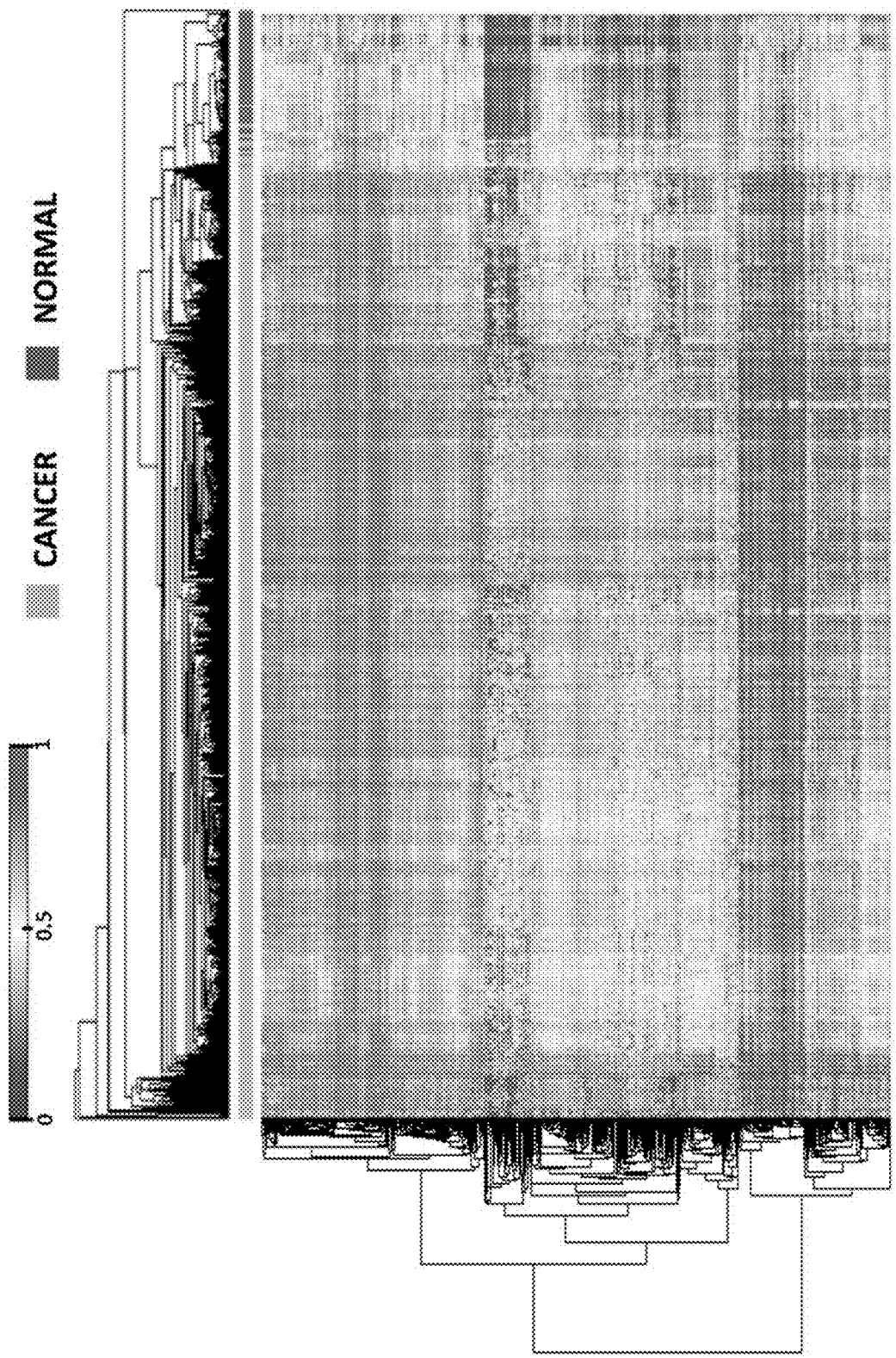
FIG. 12 illustrates heat map comparing differential expression of hyper-methylated genes in either breast cancer or liver cancer compared with matched normal tissue.
Figure 13A:
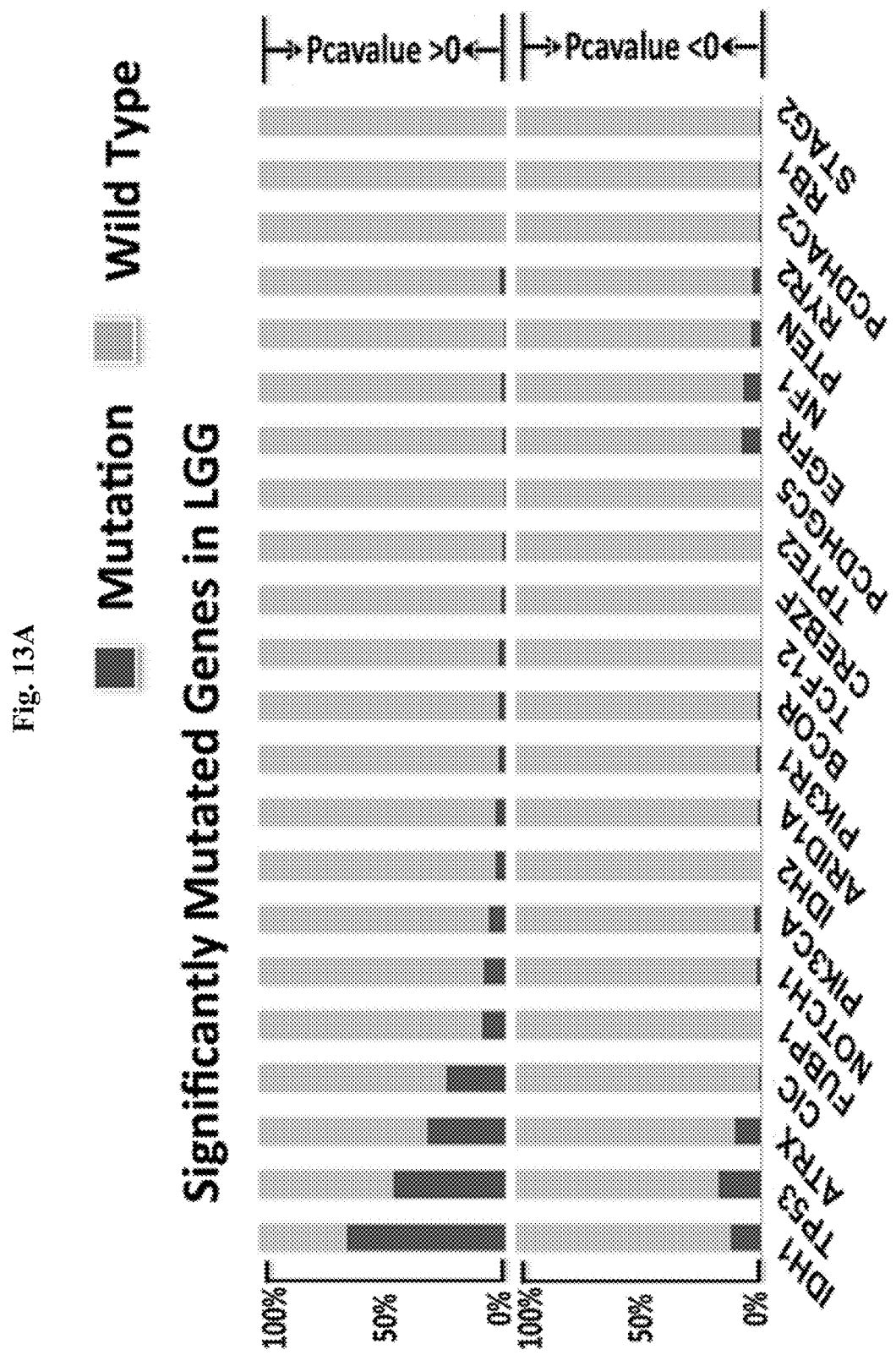
FIG. 13A-FIG. 13C illustrate RNA-seq data from TCGA as a discovery cohort to calculate the differential expression of hypermethylated genes in either breast cancer or liver cancer compared with matched normal tissue.
Figure 13B:
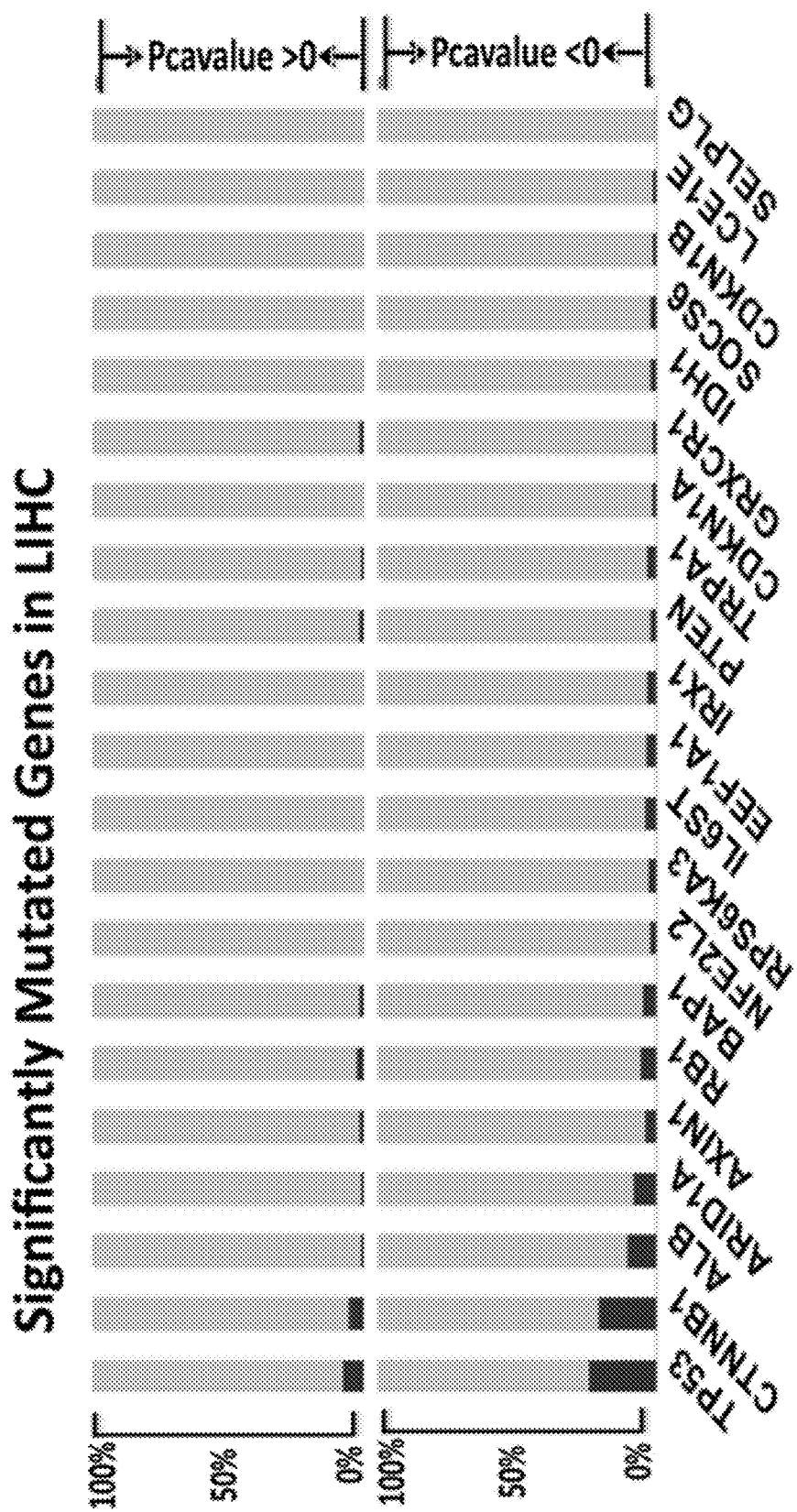
Figure 13C:

For LIHC, the total number of somatic mutations was associated with a methylation signature predicting a worse prognosis (FIG. 11C). For KIRC, FIG. 11D shows the unsupervised hierarchical clustering and heat maps associated with the methylation profile and frequently mutated genes.

Figure 15A:
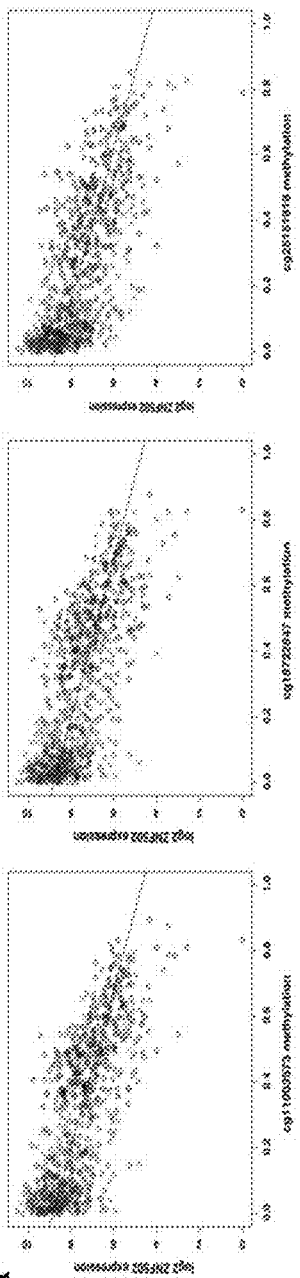
Figure 15B:
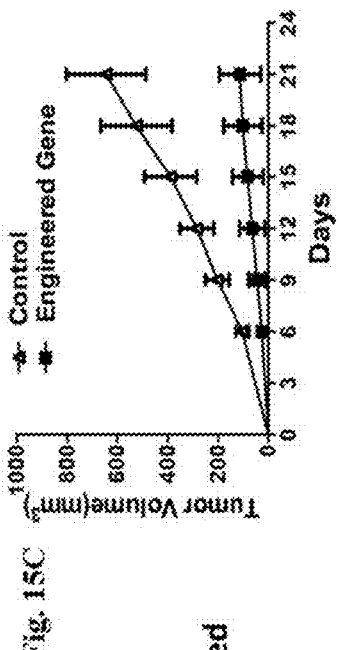
Figure 15D:
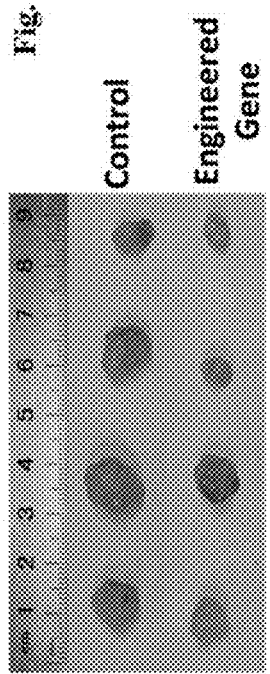
Figure 15C:
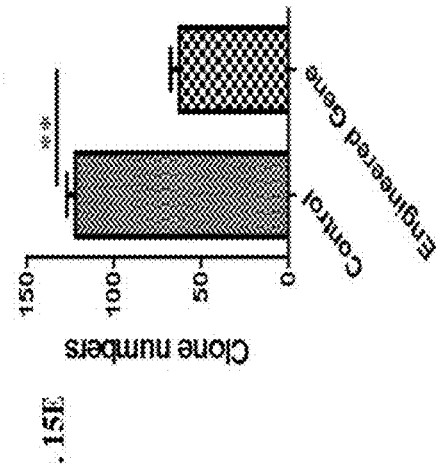
Figure 15E:
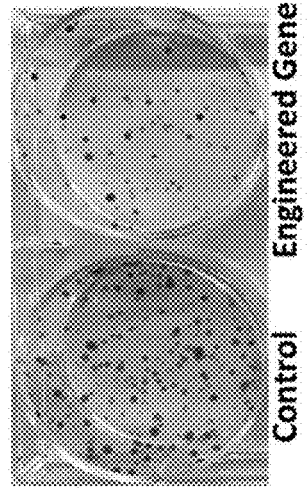

A Cancer Methylation Profile Correlated with its Gene Expression Pattern and Function Differential methylation of sites in genes in tumor versus normal tissue correlated with gene expression was further investigated. Top markers that had a mean methylation value <5% in normal tissue and >50% in cancer tissue which showed a good correlation of methylation and gene expression levels in both cancer and normal tissue were selected. RNA-seq data from TCGA was used to calculate differential expression of these genes (FIG. 15a). CpG hypermethylation was observed in cancer relative to normal samples and had a conversely decreased expression in a corresponding gene. Genes identified with newly discovered tumor suppressor functions were further tested. ZSCAN18 was selected to test its functional relevance to cancer biology, and ZNF502 has been implicated in breast cancer pathogenesis. ZNF502 is hyper-methylated in breast cancer with conversely decreased gene expression (p=xx, p=xx) (FIG. 15 A-FIG. 15E). In addition, ZNF502 expression was suppressed in breast cancer, and was observed to decrease tumor growth in cell culture and nude mice (FIG. 15G). Similarly, methylation levels in FUZ were increased in liver cancer with inversely decreased gene expression levels, and was shown to inhibit tumor growth in cell culture and nude mice (FIG. 15F-FIG. 15J)

Generate Variables 45 variables for each of the samples in the data were generated. Using the weight/marker combination, each variable V was calculated using the following equation:

$$V = \Sigma_{10}^{1}(W*M)$$

where W is the weight and M is the methylation Beta-value between 0 and 1 of the corresponding marker. A matrix was generated where the dimensions are (1) the number of samples by (2) 190 variables.

Classifying Samples

The above mentioned matrix was used to classify the samples. There are several classification algorithms that were used here including Logistic Regression, Nearest Neighbor (NN) and Support Vector Machines (SVM). Analysis using SVM were used in all subsequent analyses.

The Kernel-Based Machine Learning Lab (kernlab) library for R was used to generate the Support Vector Machines. The best results were with the "RBF" kernel. The Crammer, Singer algorithm had slightly better results than the Weston, Watson algorithm. In the analysis, four potential types of classification errors were seen.

1. Incorrect Tissue; e.g. colon tissue is identified as lung tissue.
2. False negative; e.g. lung cancer is identified as normal lung
3. False positive; e.g. normal colon is identified as colon cancer
4. Correct tissue, incorrect cancer type; e.g. kidney renal clear cell carcinoma is identified as kidney renal papillary cell carcinoma.

Three methods were used to validate the results:
1. The samples were divided into five equal parts and 4 of the parts were used for training and the fifth part was used to test the results.
2. Leave one out scenario was used where all of the samples were used for training except one. The one left out was used for testing. This was repeated for each sample until they had all been tested.

3. Two stage replication study: The samples were divided into two sets at the beginning of the process. With the training set, 10 markers in each comparison with the highest t-test scores were identified. These markers were then used to generate principal components and then used these variables to create a SVM. The obtained markers were applied to the test set, and principal components and SVM results were generated.

Tumor DNA Extraction

Genomic DNA extraction from pieces of freshly frozen healthy or cancer tissues was performed with QIAamp DNA Mini Kit (Qiagen) according to manufacturer's recommendations. Roughly 0.5 mg of tissue was used to obtain on average 5 µg of genomic DNA. DNA was stored at −20° C. and analyzed within one week of preparation.

DNA Extraction from FFPE Samples

Genomic DNA from frozen FFPE samples was extracted using QIAamp DNA FFPE Tissue Kit with several modifications. DNA was stored at −20° C. for further analysis.

Bisulfite Conversion of Genomic DNA

1 µg of genomic DNA was converted to bis-DNA using EZ DNA Methylation-Lightning™ Kit (Zymo Research) according to the manufacturer's protocol. Resulting bis-DNA had a size distribution of ~200-3000 bp, with a peak around ~500-1000 bp. The efficiency of bisulfite conversion was >99.8% as verified by deep-sequencing of bis-DNA and analyzing the ratio of C to T conversion of CH (non-CG) dinucleotides.

Determination of DNA Methylation Levels of the Second Validation Cohort by Deep Sequencing of Bis-DNA Captured with Molecular-Inversion (Padlock) Probes CpG markers whose methylation levels significantly differed in any of the comparison between a cancer tissue and normal tissue were used to design padlock probes for sequencing. Padlock-capture and sequencing of bis-DNA was based on the technique developed by G. Church and colleagues (Porreca G J, Nat Methods. 2007 November; 4 (11):931-6.) and K. Zhang and colleagues (Diep, D Nat Methods. 2012 Feb. 5; 9(3):270-2, Deng, J. et al. Nat. Biotechnol. 27, 353-360 (2009)) with modifications.

Probe Design and Synthesis

Padlock probes were designed using the ppDesigner software (Diep, D, Nat Methods. 2012 Feb. 5; 9(3):270-272). The average length of the captured region was 70 bp, with the CpG marker located in the central portion of the captured region. To prevent bias introduced by unknown methylation status of CpG markers, capturing arms were positioned exclusively within sequences devoid of CG dinucleotides. Linker sequence between arms contained binding sequences for amplification primers separated by a variable stretch of Cs to produce probes of equal length. The average length of probes was 91 bp. Probes incorporated a 6-bp unique molecular identifier (UMI) sequence to allow for the identification of individual molecular capture events and accurate scoring of DNA methylation levels.

Probes were synthesized as separate oligonucleotides using standard commercial synthesis methods. For capture experiments, probes were mixed, in-vitro phosphorylated with T4 PNK (NEB) according to manufacturer's recommendations and purified using P-30 Micro Bio-Spin columns (Bio-Rad).

Bis-DNA Capture 20 ng of bisulfite-converted DNA was mixed with a defined molar ratio of padlock probes in 20 µl reactions containing 1× Ampligase buffer (Epicentre). The optimal molar ratio of probes to DNA was determined experimentally to be 20,000:1. Reactions were covered with 50 µl of mineral oil to prevent evaporation. To anneal probes to DNA, 30 second denaturation at 95° C. was followed by a slow cooling to 55° C. at a rate of 0.02° C. per second. Hybridization was left to complete for 15 hrs at 55° C. To fill gaps between annealed arms, 5 µl of the following mixture was added to each reaction: 2 U of PfuTurboCx polymerase (pre-activated for 3 min at 95° C. (Agilent)), 0.5 U of Ampligase (Epicentre) and 250 pmol of each dNTP in 1× Ampligase buffer. After 5 hour incubation at 55° C., reactions were denatured for 2 minutes at 94° C. and snap-cooled on ice. 5 µl of exonuclease mix (20 U of Exo I and 100 U of ExoIII, both from Epicentre) was added and single-stranded DNA degradation was carried out at 37° C. for 2 hours, followed by enzyme inactivation for 2 minutes at 94° C.

Circular products of site specific capture were amplified by PCR with concomitant barcoding of separate samples. Amplification was carried out using primers specific to linker DNA within padlock probes, one of which contained specific 6 bp barcodes. Both primers contained Illumina next-generation sequencing adaptor sequences. PCR was done as follows: 1× Phusion Flash Master Mix, 3 µl of captured DNA and 200 nM final [c] of primers, using the following cycle: 10 s @ 98° C., 8× of (1 s @ 98° C., 5 s @ 58° C., 10 s @ 72° C.), 25× of (1 s @ 98° C., 15 s @ 72° C.), 60 s @ 72° C. PCR reactions were mixed and the resulting library was size selected to include effective captures (~230 bp) and exclude "empty" captures (~150 bp) using Agencourt AMPure XP beads (Beckman Coulter). Purity of the libraries was verified by PCR using Illumina flowcell adaptor primers (P5 and P7) and the concentrations were determined using Qubit dsDNA HS assay (Thermo Fisher). Libraries were sequenced using MiSeq and HiSeq2500 systems (Illumina).

Optimization of Capture Coverage Uniformity

Deep sequencing of the original pilot capture experiments showed significant differences between number of reads captured by most efficient probes and non-efficient probes (60-65% of captured regions with coverage >0.2 of average). To ameliorate this, relative efficiencies were calculated from sequencing data and probes were mixed at adjusted molar ratios. This increased capture uniformity to 85% of regions at >0.2 of average coverage.

Sequencing Data Analysis

Mapping of sequencing reads was done using the software tool bisReadMapper (Diep, D, Nat Methods. 2012 Feb. 5; 9(3):270-272) with some modifications. First, UMI were extracted from each sequencing read and appended to read headers within FASTQ files using a custom script generously provided by D.D. Reads were on-the-fly converted as if all C were non-methylated and mapped to in-silico converted DNA strands of the human genome, also as if all C were non-methylated, using Bowtie2 (Langmead B, Salzberg S. Fast gapped-read alignment with Bowtie 2. Nature Methods. 2012, 9:357-359). Original reads were merged and filtered for single UMI, i.e. reads carrying the same UMI were discarded leaving a single one. Methylation frequencies were extracted for all CpG markers for which padlock probes were designed. Markers with less than 20 reads in any sample were excluded from analysis. This resulted in ~600 CpG markers for which the methylation level was determined with the accuracy of about 5% or more.

DNA/RNA Isolation and Quantitative PCR

Tumor and corresponding far site samples were obtained from patients undergoing surgical tumor resection; samples were frozen and preserved in at −80° C. until use. Isolation of DNA and RNA from samples was performed using AllPrep DNA/RNA Mini kit (Qiagen, Valencia, Calif.), and RNA was subjected to on-column DNase digestion. RNA was quantified using a Nanodrop 2000, 200 ng RNA of each sample was used for complementary DNA synthesis using iScript cDNA synthesis kit (Bio-rad, Inc) according to the manufacturer's instructions. Briefly, samples were incubated for 5 min at 25° C., 30 min at 42° C., followed by incubation at 85° C. for 5 min. qPCR was performed by 40-cycle amplification using gene-specific primers (Table 51) and a Power SYBR Green PCR Master Mix on a 7500 Real Time PCR system (Applied Biosystems). Measurements were performed in triplicates and normalized to endogenous ACTB levels. Relative fold change in expression was calculated using the ΔΔCT method (cycle threshold values <30). Data are shown as mean±s.d. based on three replicates.

TABLE 51

Primers used for Real-time PCR

| Gene | Forward Primer | Reverse Primer |
|---|---|---|
| ACACB | GACGAGCTGATCTCCATCCTCA (SEQ ID NO: 1776) | ATGGACTCCACCTGGTTATGCC (SEQ ID NO: 1777) |
| AGER | CACCTTCTCCTGTAGCTTCAGC (SEQ ID NO: 1778) | AGGAGCTACTGCTCCACCTTCT (SEQ ID NO: 1779) |
| ARHGEF 17 | ATGACCCTGCTGGACACAGAGC (SEQ ID NO: 1780) | ACGGAGTTCTCTGGCTGCTTCA (SEQ ID NO: 1781) |
| ACTB | CACCATTGGCAATGAGCGGTTC (SEQ ID NO: 1782) | AGGTCTTTGCGGATGTCCACGT (SEQ ID NO: 1783) |
| BCO2 | CTACCTCTGCACTGAGACCAAC (SEQ ID NO: 1784) | GTGCAGTTGCTCCATTCACAGC (SEQ ID NO: 1785) |
| CGN | CAAGGAGGATCTTAGAGCCACC (SEQ ID NO: 1786) | TGGCGAGTATCTCCAGCACTAG (SEQ ID NO: 1787) |
| CLDN10 | GGCTGTGCTCAATGACTGGATG (SEQ ID NO: 1788) | GCCCATCCAATAAACAGAGCGG (SEQ ID NO: 1789) |
| CLDN18 | ATGGAGGACTCTGCCAAAGCCA (SEQ ID NO: 1790) | TGGACATCCAGAAGTTAGTCACC (SEQ ID NO: 1791) |
| EMP2 | CCTGGTGGGTAGGAGATGAGTT (SEQ ID NO: 1792) | GAGAATGGTGGAGAGGATCATGG (SEQ ID NO: 1793) |
| GATA6 | GCCACTACCTGTGCAACGCCT (SEQ ID NO: 1794) | CAATCCAAGCCGCCGTGATGAA (SEQ ID NO: 1795) |
| GATA6 | GCCACTACCTGTGCAACGCCT (SEQ ID NO: 1796) | CAATCCAAGCCGCCGTGATGAA (SEQ ID NO: 1797) |
| GRASP | GCTCAGGATTCCGCTGGAAGAA (SEQ ID NO: 1798) | AGGTCACCATTTCCACACGCTG (SEQ ID NO: 1799) |
| GLS2 | TGAGGCACTGTGCTCGGAAGTT (SEQ ID NO: 1800) | TCGAAGAGCTGAGACATCGCCA (SEQ ID NO: 1801) |
| GPR116 | CATTGGCGGGACCATCACTTAC (SEQ ID NO: 1802) | CCTTCAGGTATGTAGGGAGCATC (SEQ ID NO: 1803) |
| JDP2 | CACTTCCTGGAGGTGAAACTGG (SEQ ID NO: 1804) | GAAACTCCGTGCGCTCCTTCTT (SEQ ID NO: 1805) |
| KHDRBS2 | GCTTGGACCAAGAGGAAACTCC (SEQ ID NO: 1806) | CAAGTGGGCATATTTGGCTTCCC (SEQ ID NO: 1807) |
| LIFR | CACCTTCCAAAATAGCGAGTATGG (SEQ ID NO: 1808) | ATGGTTCCGACCGAGACGAGTT (SEQ ID NO: 1809) |
| MAS1L | CTCTCAGAGTGATTCTCCAACGG (SEQ ID NO: 1810) | GGTTCTCCACATGCTGAGTAGAG (SEQ ID NO: 1811) |
| NR3C2 | AAATCACACGGCGACCTGTCGT (SEQ ID NO: 1812) | ATGGCATCCTGAAGCCTCATCC (SEQ ID NO: 1813) |
| NR5A2 | GGCTTATGTGCAAAATGGCAGATC (SEQ ID NO: 1814) | GCTCACTCCAGCAGTTCTGAAG (SEQ ID NO: 1815) |
| NOD1 | CAACGGCATCTCCACAGAAGGA (SEQ ID NO: 1816) | CCAAACTCTCTGCCACTTCATCG (SEQ ID NO: 1817) |
| PRKCE | AGCCTCGTTCACGGTTCTATGC (SEQ ID NO: 1818) | GCAGTGACCTTCTGCATCCAGA (SEQ ID NO: 1819) |

TABLE 51-continued

Primers used for Real-time PCR

| Gene | Forward Primer | Reverse Primer |
|---|---|---|
| RAPGEF2 | GTTGGATTGCCGACTGGAAGGA (SEQ ID NO: 1820) | CTCTCAGACTCCAAGGATGTGG (SEQ ID NO: 1821) |
| RGS6 | GGCACCTTTTATCGTTTCCAGGC (SEQ ID NO: 1822) | TCTGCCAGTTCCAGCCTTGCTT (SEQ ID NO: 1823) |
| STAT5A | GTTCAGTGTTGGCAGCAATGAGC (SEQ ID NO: 1824) | AGCACAGTAGCCGTGGCATTGT (SEQ ID NO: 1825) |
| SMAD7 | TGTCCAGATGCTGTGCCTTCCT (SEQ ID NO: 1826) | CTCGTCTTCTCCTCCCAGTATG (SEQ ID NO: 1827) |
| TGFBR2 | GTCTGTGGATGACCTGGCTAAC (SEQ ID NO: 1828) | GACATCGGTCTGCTTGAAGGAC (SEQ ID NO: 1829) |

Figure 14:
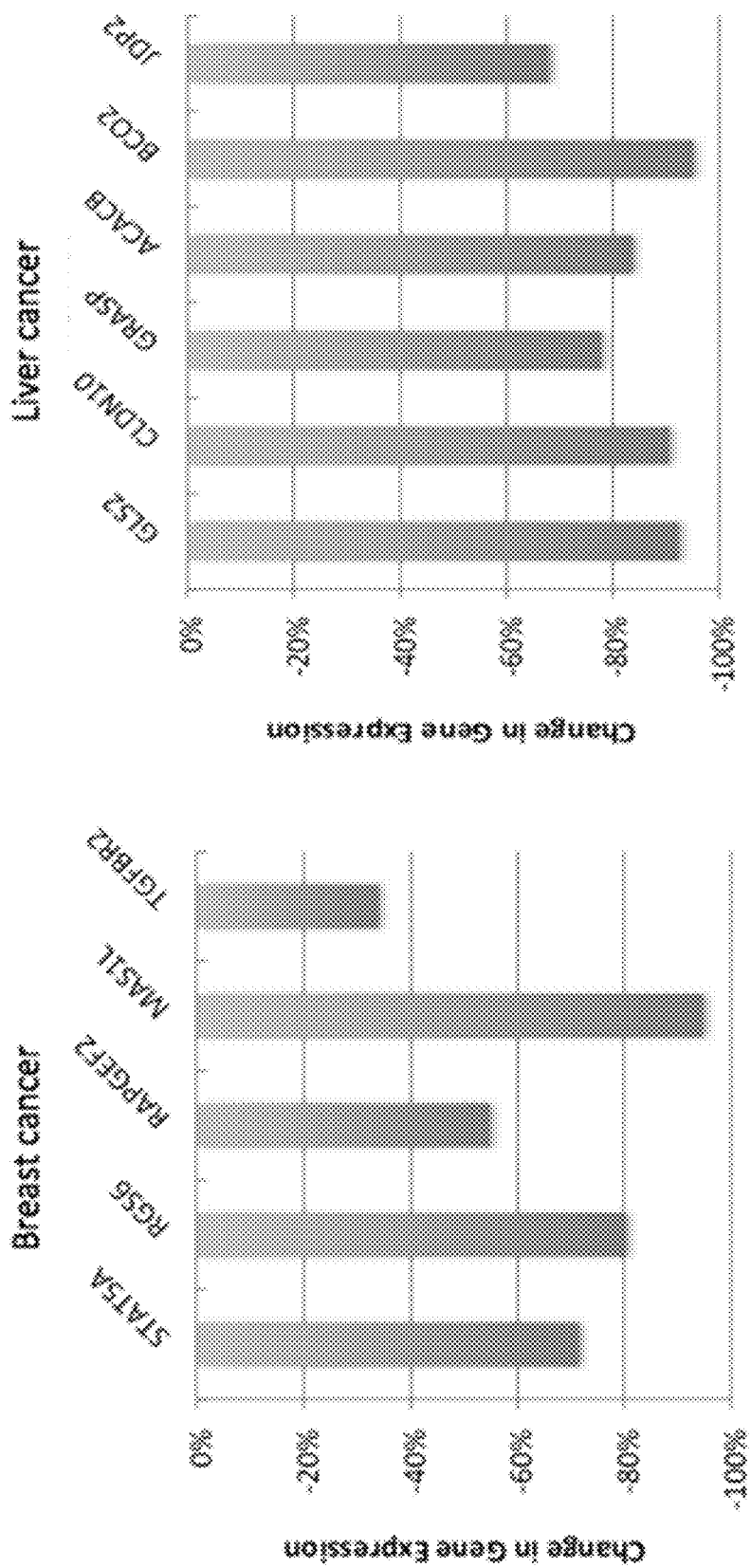
FIG. 14 shows graphs that illustrate methylation patterns correlate with gene expression profiles and cancer behaviors. The mRNA expression of differentially methylated genes in breast cancer and liver cancer was determined using qPCR. The mRNA expression in tumor samples was normalized to expression in nearby normal tissue derived from the same patient. Results are shown as average percent change in expression of multiple samples (n=3-7), with each sample performed in 3 technical replicates. All samples were pooled together for statistical analysis using a Wilcoxon sign-rank test to determine whether gene expression changes inversely with methylation, as predicted; p-value on pooled samples was determined to be $1.21 \times 10^{-21}$.

The correlation of differential methylation of CpG sites in genes with gene expression in tumor versus normal tissue in the cohort was further investigated. Top differentially methylated CpG markers that showed hyper-methylation in either breast cancer or liver cancer when compared with that of its matched normal tissue were selected. RNA-seq data from TCGA was utilized as a discovery cohort to calculate differential expression of these genes compared with matched normal tissue (FIG. 12 and FIGS. 13A-C). RT-qPCR was used to characterize expression of these genes in the cancer tissue collection as a validation cohort (FIG. 14). Decreased expression was observed in each of these hyper-methylated genes.

Tumor Xenograft

All animal studies were performed in accordance with institutional and international animal regulations. Animal protocols were approved by the Institutional Animal Care and Use Committee of Sun Yat-Sen University Cancer Center and West China Hospital. Female athymic BALB/c nude mice (4-5 weeks of age, 18-20 g) were purchased from a vendor (Guangdong Province Laboratory Animal Center, Guangzhou, China). Tumor cells were suspended in 100 µl of serum free medium and injected subcutaneously onto the mice. The growth of tumors was monitored every 3 days by examination until the largest tumor reached tumor burden defined as 10 mm or larger in size. Tumor sizes were measured using a caliper, and tumor volume was calculated according to the following equation: tumor volume (mm3) =(length (mm)×width (mm)2)×0.5. Representative data were obtained from five mice per experimental group. Statistical analyses were performed with one-way repeated-measures ANOVA.

Example 5—DNA Methylation Based Signatures and Diagnosis and Prognosis of Colon Cancer and its Metastasis Approvals This project was approved by IRB of Sun Yat-sen University Cancer Center and West China Hospital. Informed consent was obtained from all patients. Tumor and normal tissues were obtained after patients signed an informed consent.

Occult Cancer

Patients with metastatic adenocarcinoma of unknown origin were enrolled in this study. They presented with progressive weight loss, fatigue and weakness. Workup included detailed history, complete exam including pelvic, rectal, testicular tissues, labs tests including CBC, CMP, UA, stool occult blood, histopathology, Imaging, endoscopy.

Characteristics of Patients and Tissues

Since the goal was to diagnose colon cancer and its metastasis, it was necessary to generate accurate cancer signatures for liver cancer and lung adenocarcinoma in addition to colon cancer, as liver and lung are the most frequent sites of metastasis. Therefore, 2487 cancer and normal patients were studied (Table 52 and FIG. 21). Adjacent normal tissue derived from the same patients was used as controls. These normal tissues were verified by histology to have no evidence of cancer.

TABLE 52

Summary of three cancer cohorts

| | Training | Testing1 | Testing2 | total |
|---|---|---|---|---|
| cancer_colon/rectal | 390 | 124 | 161 | 675 |
| nomal_colon/rectal | 45 | 12 | 164 | 221 |
| Colon/rectum Cancer Metastatic to liver | 0 | 0 | 33 | 33 |
| Colon/rectum Cancer Metastatic to liver | 0 | 0 | 34 | 34 |
| cancer_liver | 238 | 70 | 48 | 356 |
| nomal_liver | 50 | 17 | 73 | 140 |
| cancer_lung | 311 | 199 | 47 | 557 |
| nomal_lung | 74 | 23 | 46 | 143 |
| total | 1108 | 445 | 606 | 2159 |

Generating a Cancer Marker Set

To identify a cancer-type specific signature, comparisons were made to identify methylation differences between a particular cancer type and its surrounding normal tissue for colon, liver, and lung cancer. Three pair-wise comparison analyses were made for generating cancer- and tissue-specific methylation signatures: 1) the pair-wise methylation difference between a particular cancer type versus its corresponding normal tissue, 2) the difference between two different cancer types, and 3) the difference between two different normal tissues. With a total of 6 tissue groups including 3 tumor groups and 3 normal tissue groups, a total of 15 unique pair-wise comparisons (6*5/2) were performed. Using an Illumina 470,000 CpG methylation microarray, 450,000 markers were utilized per comparison using the [column t test] colttests( ) function in the R genefilter package. Markers were ranked by both lowest p values as determined by t-statistic tests and the largest difference in a mean methylation fraction between each comparison and selected the top ten markers in each group for further validation analysis. After 15 comparisons, 127 unique, non-redundant markers were generated as a cancer panel.

Figure 16:
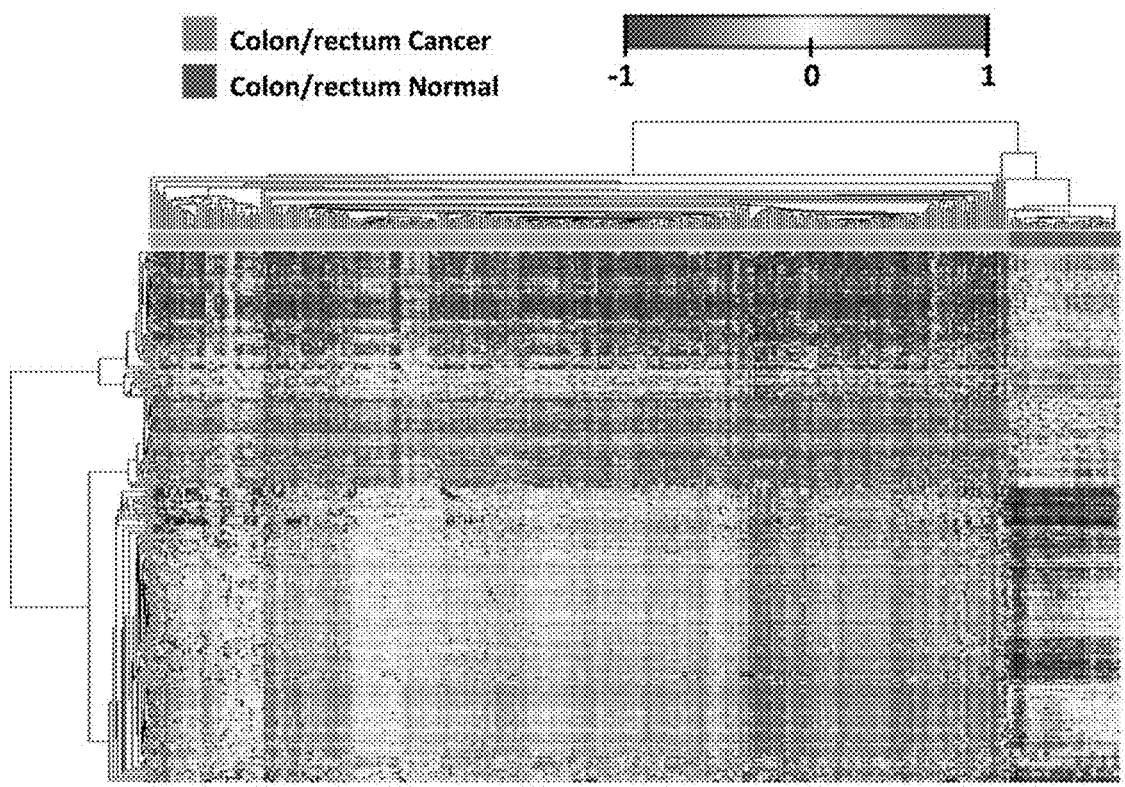
FIG. 16 illustrates DNA methylation signatures associated with colon cancer. Unsupervised hierarchical clustering and heat map associated with the methylation profile of the 435 TCGA specimens (colon cancer: 390; colon normal: 45) with a panel of 311 CpG markers. Each column represents an individual patient and each row represents an individual CpG marker.
Figure 17:
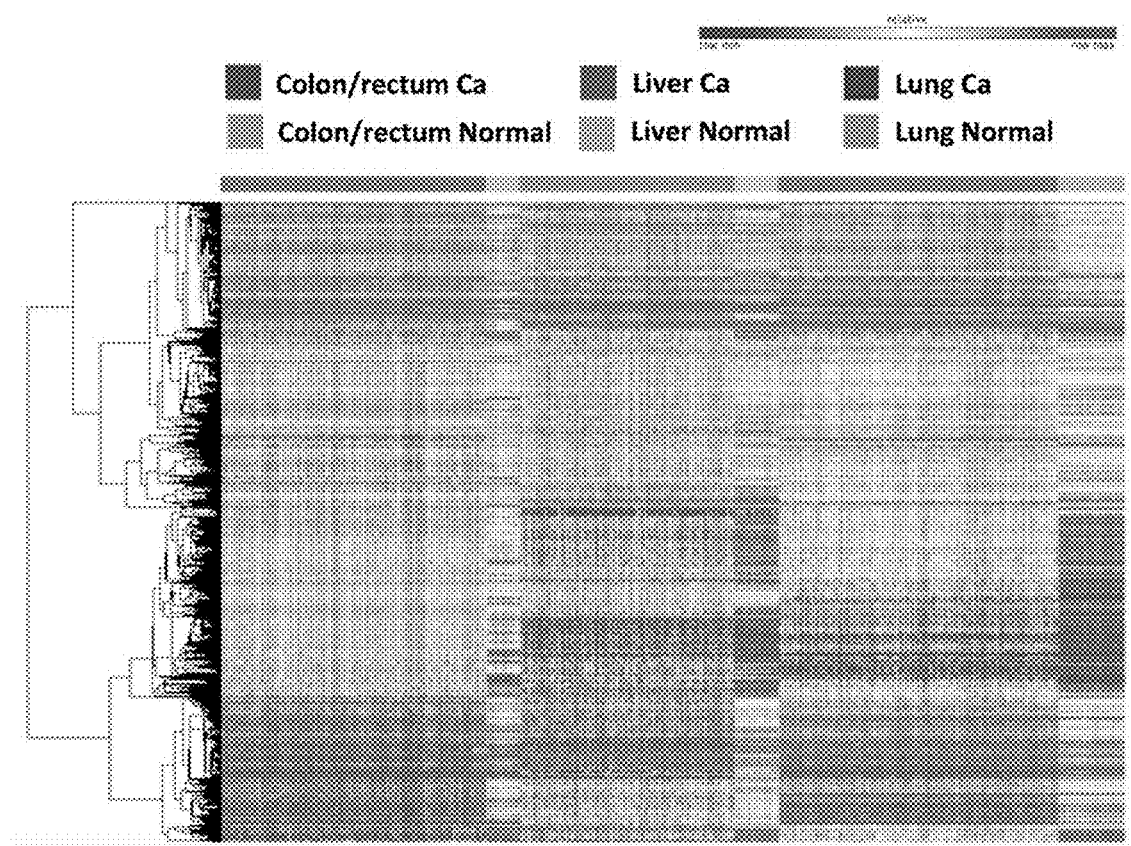
FIG. 17 illustrates DNA methylation signatures associated with colon, lung, and liver cancer. Unsupervised hierarchical clustering and heat map associated with the methylation profile of the 1108 TCGA specimens (colon cancer: 390; colon normal: 45; liver cancer: 238; liver normal: 50; lung cancer: 311; lung normal: 74) based on 2793 CpG markers. Each column represents an individual patient and each row represents an individual CpG marker.
Figure 19A:
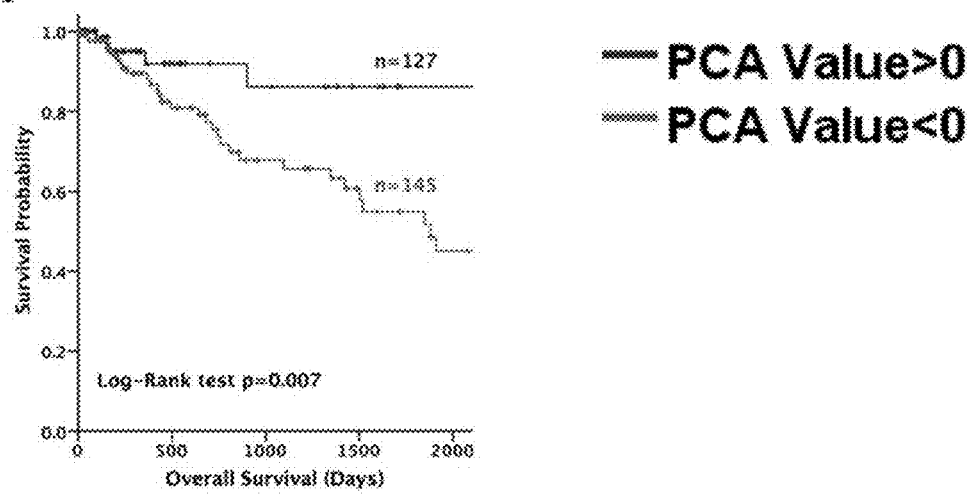
FIG. 19A-FIG. 19E illustrates methylation markers which are used to predict overall survival of colon adenocarcinoma (COAD) patients in Kaplan-Meier curve.
Figure 19B:
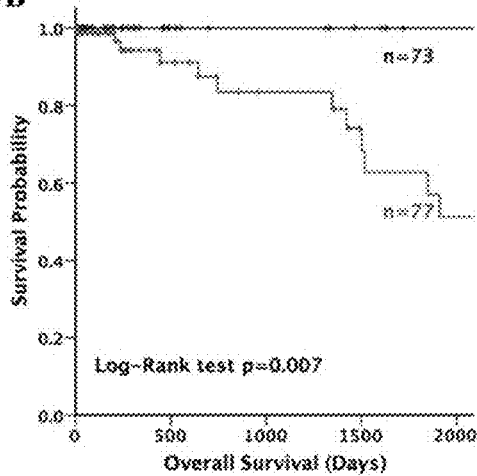
Figure 19C:
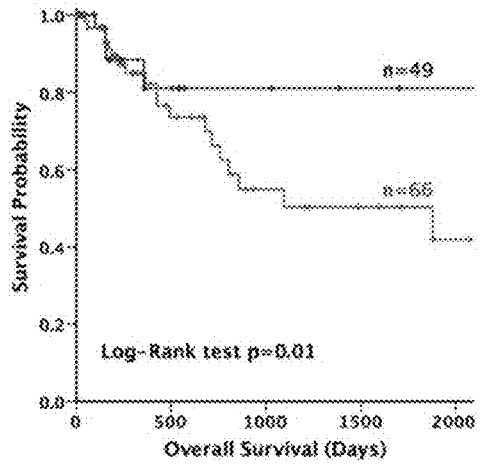
Figure 19D:
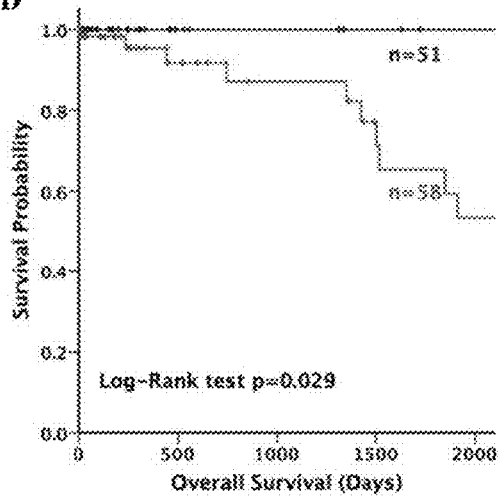
Figure 19E:
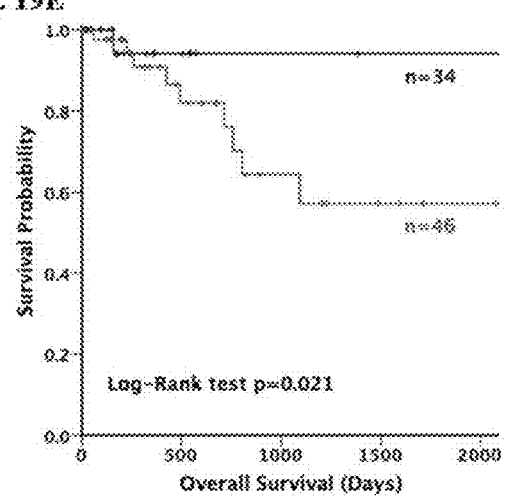
Figure 20A:
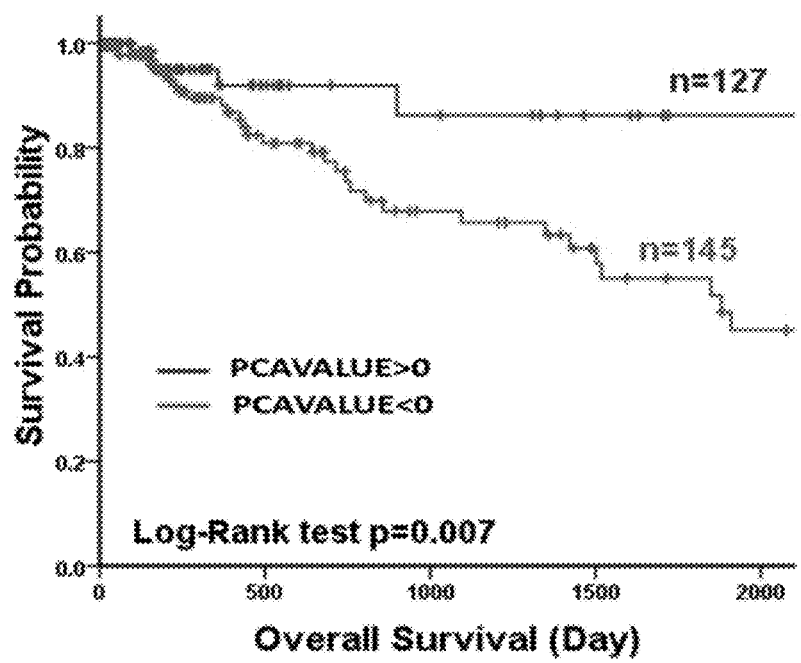
Figure 20B:
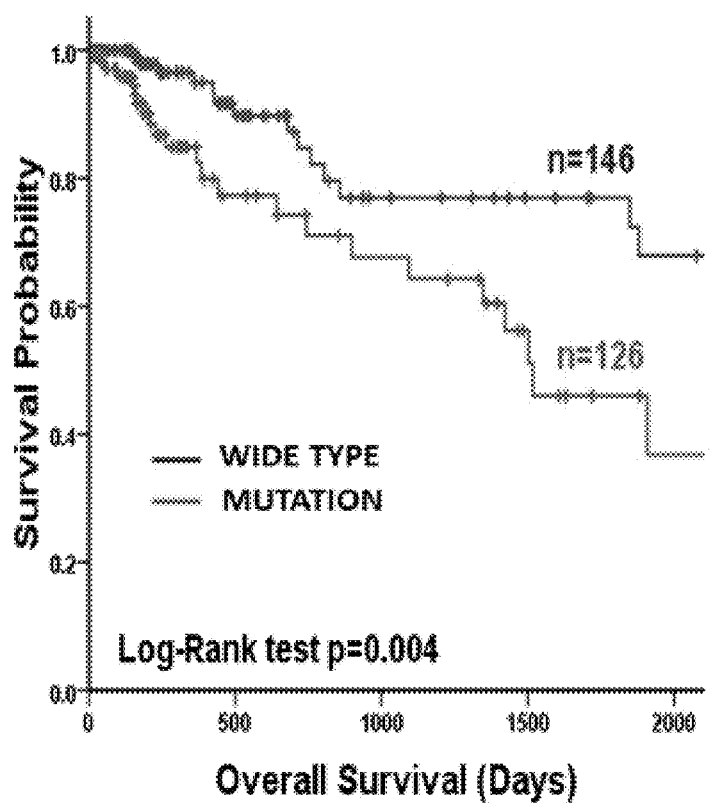
Figure 20C:
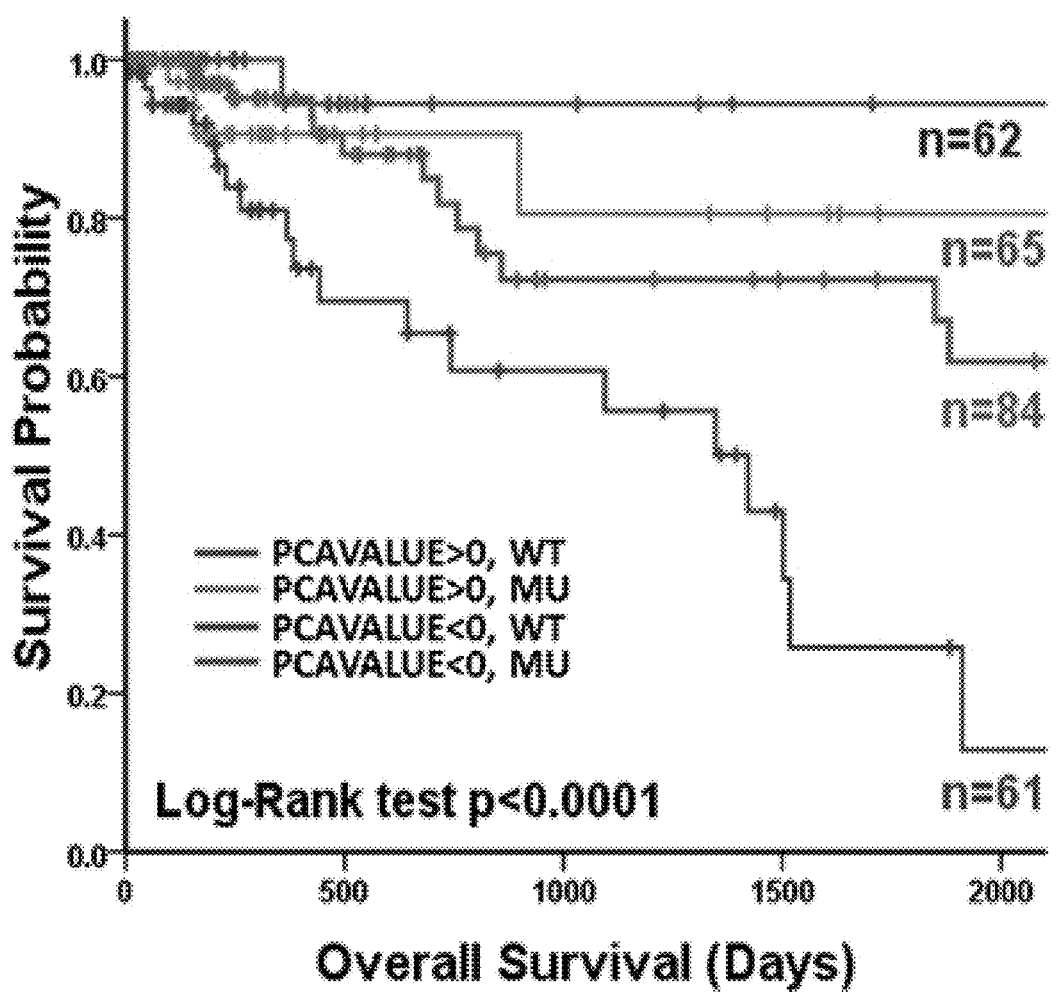
Figure 20D:
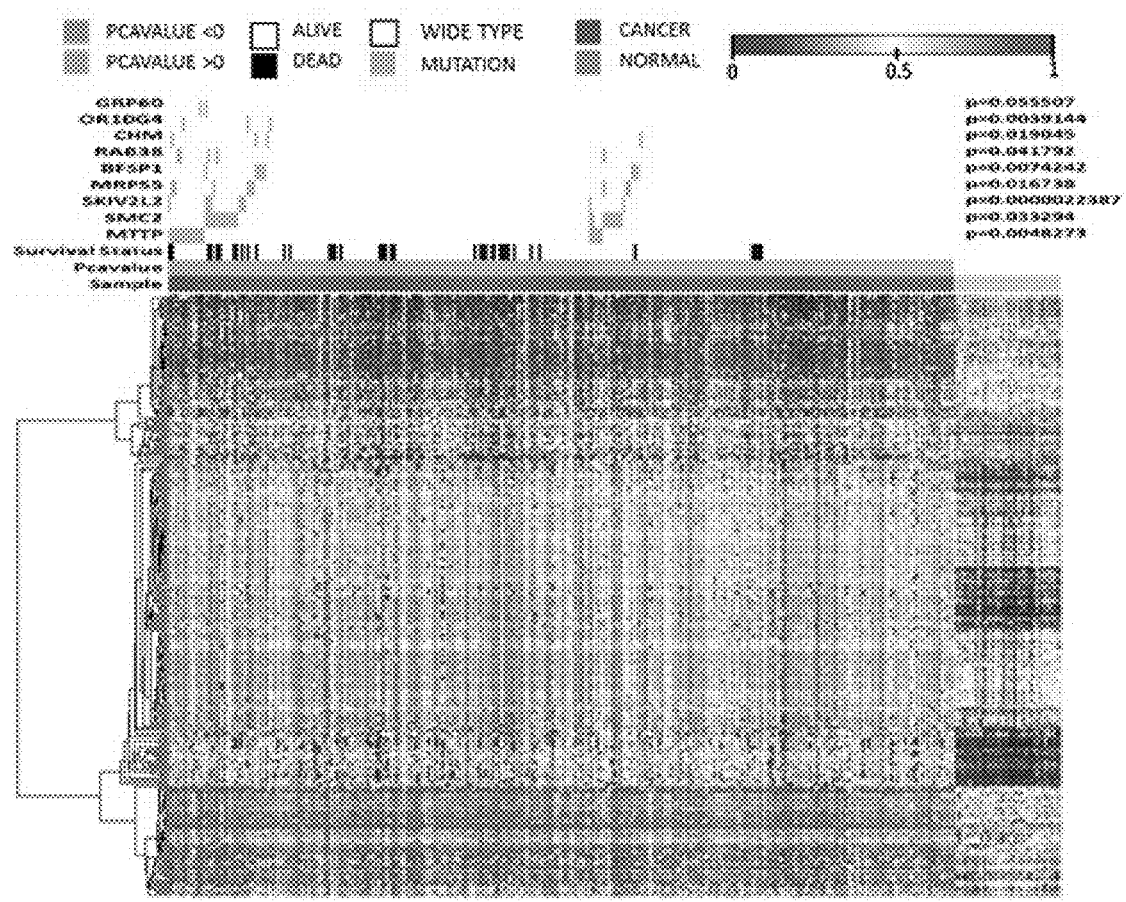

Differences between different cancer types, as well as differences between three normal tissues in a pair-wise fashion were compared. Analysis of a genome-wide DNA methylation (obtained using the Illumina 470,000 CpG methylation microarray) profile of the training cohort of 1467 patients from the TCGA was performed. 127 unique, non-redundant markers were generated as a cancer panel. Hierarchical clustering of these 127 top-ranked CpG sites was plotted in an unsupervised fashion in the 390 colon/rectal cancer and 45 normal colon/rectal samples (FIG. 16). Then the different cancer types (colon, liver, lung cancer) were compared using 939 cancer and 169 normal samples with another 142 markers (FIG. 17).

The hierarchical clustering was able to distinguish each cancer type from each other and from normal tissue. The TCGA samples were randomly divided into a training and a testing cohort and a training cohort consisted of 939 cancer samples and 169 normal samples. Hierarchical clustering of the training cohort was used to distinguish cancer types and normal tissues based on methylation pattern (Table 53A). 926 of 939 of cancer samples and 166 of 169 of normal samples were identified correctly, yielding an overall sensitivity of 98.6% and specificity of 99%. A consistently high specificity and sensitivity in each individual cancer was observed (Table 53A). The ability of the algorithm to identify cancers was validated in a separate TCGA testing cohort consisting of 393 cancer and 52 normal samples (Table 53B). Similar results in this cohort were achieved, with 384 of samples identified correctly as cancer, and 47 identified correctly as normal. The overall sensitivity and specificity in this validation cohort were 97.7% and 90.4% respectively, with very similar prediction characteristics as in the training cohort. This algorithm was then tested in another testing cohort consisting of 289 cancer and 283 normal samples (Table 53C). Again, an overall sensitivity and specificity of 94.1% and 97.9% respectively was observed, with very similar prediction characteristics as in the training cohort. The third cohort of samples was tested using a next generating sequencing platform, thus reducing the possibility of platform bias or systematic error. Overall, these results demonstrate the robust nature of these methylation patterns in identifying the presence of malignancy as well as its site of origin.

TABLE 53A

TCGA Training cohort

| Training Cohort | Colon/ rectum Ca | Liver Ca | Lung Ca | Normal Colon/ rectum | Normal Liver | Normal Lung | |
|---|---|---|---|---|---|---|---|
| Colon/rectum Ca | 388 | | | | | | |
| Liver Ca | | 235 | | | 1 | | |
| Lung Ca | | | 303 | | | 2 | |
| Normal colon/rectum | 1 | | | 45 | | | |
| Normal liver | | 3 | | | 49 | | |
| Normal lung | | | 4 | | | 72 | Totals |
| Totals | 390 | 238 | 311 | 45 | 50 | 74 | 1118 |
| Correct | 388 | 235 | 303 | 45 | 49 | 72 | 1092 |
| False Positive | | | | | 1 | 2 | 3 |
| False Negative | 1 | 3 | 4 | | | | 8 |
| Wrong Tissue | 1 | | 4 | | | | 5 |
| Correct (%) | 99.5 | 98.7 | 97.4 | 100.0 | 98.0 | 97.3 | 98.6 |

TABLE 53B

TCGA Testing cohort 1

| Testing Cohort1 | Colon/ rectum Ca | Liver Ca | Lung Ca | Normal Colon/ rectum | Normal Liver | Normal Lung | |
|---|---|---|---|---|---|---|---|
| Colon/rectum Ca | 124 | | | | | | |
| Liver Ca | | 67 | 5 | | 3 | | |
| Lung Ca | | | 193 | | | 2 | |
| Normal colon/rectum | | | | 12 | | | |
| Normal liver | | 2 | | | 14 | | |
| Normal lung | | | 1 | | | 21 | Totals |
| Totals | 124 | 70 | 199 | 12 | 17 | 23 | 445 |
| Correct | 124 | 67 | 193 | 12 | 14 | 21 | 431 |
| False Positive | | | | | 3 | 2 | 5 |
| False Negative | | 2 | 1 | | | | 3 |
| Wrong Tissue | | 1 | 5 | | | | 6 |
| Correct (%) | 100 | 95.7 | 97 | 100 | 82.4 | 91.3 | 96.9 |

TABLE 53C

Chinese Testing cohort (Testing cohort 2)

| Testing Cohort 21 | Colon/ rectum Ca | Colon/ rectum mets to liver | Colon/ rectum Ca mets to lung | Liver Ca | Lung Ca | Normal Colon/ rectum | Normal Liver | Normal Lung | |
|---|---|---|---|---|---|---|---|---|---|
| Colon/rectum Ca | 153 | 31 | 32 | | 1 | | | | |
| Liver Ca | | | | 45 | 1 | | | | |
| Lung Ca | | | | | 42 | | | 1 | |
| Normal Colon/rectum | 7 | | | | | 164 | | | |
| Normal Liver | | 2 | | 2 | | | 72 | | |
| Normal Lung | 1 | | 2 | | 1 | | | 44 | Totals |
| Totals | 161 | 33 | 34 | 48 | 47 | 164 | 73 | 46 | 606 |
| Correct | 153 | 31 | 32 | 45 | 43 | 164 | 72 | 41 | 581 |
| False Positive | | | | | | | 1 | 1 | 2 |
| False Negative | 7 | 2 | | 2 | 1 | | | | 12 |
| Wrong Tissue | 1 | | 2 | 1 | 3 | | | 4 | 11 |
| Correct (%) | 95.0 | 93.9 | 94.1 | 93.8 | 91.5 | 100 | 98.6 | 89.1 | 95.9 |

Next, the potential for using methylation signatures for determining the presence of cancer and tissue of origin in metastasis was explored. Samples of various normal and cancerous lesions from a cohort of Chinese patients was collected (Table 52). This signature can reproducibly identify origin of cancer in metastatic lesions in liver, lung and lymph nodes. Moreover, a panel of cancers of unknown origin was tested, and found that all can be predicted from primary colon adenocarcinomas (FIG. 18).

Calculate Weights for Top Ten Markers in Each Comparison.

Principle Component analysis was applied to the top ten markers in each comparison group using the prcomp( ) function in the stats environment. Weights in the first principle component of each group were extracted and matched to the weights with the ten corresponding markers in each group. In total, there were 45 groupings of weights with markers. These markers were used to classify the samples with several algorithms including Neural Networks, Logistic Regression, Nearest Neighbor (NN) and Support Vector Machines (SVM), all of which generated consistent results. Analyses using SVM were found to be most robust and were therefore used in all subsequent analyses.

Because patterns of methylation may reflect differences in the underlying biology of particular tumors, the ability of methylation signatures to predict overall survival in the cohorts of colorectal, lung, and liver cancer patients was investigated. For each cancer, patients alive or dead at 5 years were compared and Principle Components Analysis (PCA) was used to derive a methylation signature to predict 5-year survival. Significantly different overall survival for colon cancer cohort and each subgroup was predicted based on staging (FIG. 19). The methylation signature predicted 5-year OS of 81.2% in the good prognosis group versus 42% in the poor prognosis group for all patients. In a subgroup analysis of stage I-II colon cancer patients (FIG. 19B), a group of patients with a remarkable 100% OS versus 51.3% OS at 5-years was identified. These results suggest that methylation profiling of these tumors could play a significant role in predicting prognosis and potentially guiding treatment selection.

Data Sources

DNA methylation data was obtained from several sources, including The Cancer Genome Atlas (TCGA), analysis of 485,000 sites generated using the Infinium 450K Methylation Array, and additional data from the following GSE datasets: GSE46306, GSE50192, GSE58298 and GSE41826. Methylation profiles for tumors and their corresponding normal tissue were analyzed. The methylation data files were obtained in an DAT format with the ratio values of each bead that has been scanned. The minfi package from Bioconductor was used to convert these data files into a score, referred to as a Beta value. Beta values for any markers that did not exist across all 20 of the datasets were excluded.

Generate Variables 45 variables for each of the samples in the data were generated. Using the weight/marker combination, each variable V was calculated using the following equation:

$$V = \Sigma_{10}^{1}(W*M)$$

where W is the weight and M is the methylation Beta-value between 0 and 1 of the corresponding marker. A matrix was generated where the dimensions are (1) the number of samples by (2) 190 variables.

Classifying Samples

The above mentioned matrix was used to classify the samples. There are several classification algorithms that were used here including Logistic Regression, Nearest Neighbor (NN) and Support Vector Machines (SVM). All of which generated consistent results. However, analysis using SVM were much better and more robust and were therefore used in all subsequent analyses.

The Kernel-Based Machine Learning Lab (kernlab) library for R was used to generate the Support Vector Machines. The best results were with the "RBF" kernel. The Crammer, Singer algorithm had slightly better results than the Weston, Watson algorithm. In the analysis, four potential types of classification errors were seen:
1. Incorrect Tissue; e.g. colon tissue is identified as lung tissue.
2. False negative;
3. False positive;
4. Correct tissue and prognosis, incorrect cancer type.

Three methods to validate the results were used:
1. Samples were divided into five equal parts. Four parts were used for training and the fifth to test the results.
2. A leave one out scenario, in which all of the samples were used for training except one was utilized to test the group that was left out. This was repeated for each sample until they had all been tested.
3. Two stage replication study: Samples were divided into two sets at the beginning of the process. With the training set, the 10 markers in each comparison with the highest t-test scores were selected. These markers were then used to generate principal components and the resulting variables were used to create a SVM. The obtained markers were then applied to the test set, and principal components and SVM results were generated.

With each of these methods, the prediction accuracy was above 95%. The number of tissue errors is less than 1%. Specificity was roughly 95% and sensitivity was almost 99% with the test dataset.

Tumor DNA Extraction

Starting from roughly 0.5 mg of tissue, genomic DNA was extracted using the QIAamp DNA Mini Kit (Qiagen) according to manufacturer's protocol. Both tumor and corresponding normal and metastasized tissue samples were used and 5 ug of total DNA was obtained on average. DNA were stored at −20° C. and analyzed within one week of preparation.

DNA Extraction from FFPE Samples

Genomic DNA from FFPE samples was extracted using QIAamp DNA FFPE Tissue Kit with several modifications. DNA were stored at −20° C. and analyzed within one week of preparation.

Bisulfite Conversion of Genomic DNA

1 µg of genomic DNA from healthy, tumor, and metastasized tissue was converted to bis-DNA using EZ DNA Methylation-Lightning™ Kit (Zymo Research) according to the manufacturer's protocol. Based on Tape Station analyses (Agilent), resulting bis-DNA had a size distribution of ~200-3000 bp, with a peak around ~500-1000 bp. The efficiency of bisulfite conversion was >99.8% as verified by deep-sequencing of bis-DNA and analyzing the ratio of C to T conversion of CH (non-CG) dinucleotides.

Quantification of CpG Methylation by Deep Sequencing of Bis-DNA Captured with Molecular-Inversion (Padlock) Probes CpG markers whose methylation levels significantly differed in any of the comparison between a cancer tissue and normal tissue were used to design padlock probes for sequencing. Padlock-capture and sequencing of bis-DNA was based on the technique developed by G. Church and colleagues (Porreca G J, Nat Methods. 2007 November; 4 (11):931-6.) and K. Zhang and colleagues (Diep, D Nat Methods. 2012 Feb. 5; 9(3):270-2; Deng, J. et al. Nat. Biotechnol. 27, 353-360 (2009)) with modifications.

Probe Design and Synthesis

Padlock probes were designed using the ppDesigner software (Diep, D, Nat Methods. 2012 Feb. 5; 9(3):270-272) with an average capture region length of 70 bp. CpG markers were located within the central portion of the captured region. Capturing arms were positioned exclusively within regions lacking of CG dinucleotides to prevent unintended bias introduced by unknown methylation statuses of extraneous CpG markers. The capture arms were connected by a linker sequence, which contained binding sequences for amplification primers. A variable stretch of repeating Cs were inserted between the primer sites to produce probes that were, on average, 91 bp in length. Probes incorporated a 6-bp unique molecular identifier (UMI) sequence to allow for the identification of individual molecular capture events and accurate scoring of DNA methylation levels.

Probes were synthesized as separate oligonucleotides using standard commercial synthesis methods. For capture experiments, probes were mixed, in-vitro phosphorylated with T4 PNK (NEB) according to manufacturer's recommendations, and purified using P-30 Micro Bio-Spin columns (Bio-Rad).

Bis-DNA Capture 20 ng of bisulfite-converted DNA was mixed with a defined molar ratio of padlock probes (1:20,000 as determined experimentally) in 20 µl reactions containing 1× Ampligase buffer (Epicentre). To prevent evaporation, reactions were then covered with 50 µl of mineral oil (Sigma). DNA was denatured for 30 seconds at 95° C., followed by a slow cooling to 55° C. at a rate of 0.02° C. per second to allow for the probes to anneal to the DNA. Hybridization was left to complete for 15 hrs at 55° C. To polymerize the capture region, 5 µl of the following mixture was added to each reaction: 2 U of PfuTurboCx polymerase (pre-activated for 3 min at 95° C. (Agilent)), 0.5 U of Ampligase (Epicentre) and 250 pmol of each dNTP in 1× Ampligase buffer. After 5 hour incubation at 55° C., reactions were denatured for 2 minutes at 94° C. and snap-cooled on ice. 5 µl of exonuclease mix (20 U of Exo I and 100 U of ExoIII, both from Epicentre) was added and single-stranded DNA degradation was carried out at 37° C. for 2 hours, followed by enzyme inactivation for 2 minutes at 94° C.

Circular products of site specific capture were amplified by PCR with concomitant barcoding of separate samples. Amplification was carried out using primers specific to linker DNA within padlock probes, one of which was a common amplification primer site on all probes and the other containing a unique 6 bp barcodes. Both primers contained Illumina next-generation sequencing adaptor sequences. PCR was done as follows: 1× Phusion Flash Master Mix, 3 µl of captured DNA and 200 nM final [c] of primers, using the following cycle: 10 s @ 98° C., 8× of (1 s @ 98° C., 5 s @ 58° C., 10 s @ 72° C.), 25× of (1 s @ 98° C., 15 s @ 72° C.), 60 s @ 72° C. 5 ul of each PCR reaction was mixed and the resulting library was size selected to include effective captures (~230 bp) and exclude "empty" captures (~150 bp) using Agencourt AMPure XP beads (Beckman Coulter). Purity of the libraries was verified by PCR using Illumina flowcell adaptor primers (P5 and P7) and the concentrations were determined using Qubit dsDNA HS assay (Thermo Fisher). Libraries we sequenced using MiSeq and HiSeq2500 systems (Illumina).

Optimization of Capture Coverage Uniformity

Deep sequencing of the original pilot capture experiments showed significant differences between number of reads captured by most efficient probes and non-efficient probes (60-65% of captured regions with coverage >0.2 of average). To ameliorate this, relative efficiencies were calculated from sequencing data and probes were mixed at adjusted molar ratios. This increased capture uniformity to 85% of regions at >0.2 of average coverage.

Sequencing Data Analysis

Sequencing reads were mapped using a software tool bisReadMapper (Diep, D, Nat Methods. 2012 Feb. 5; 9(3): 270-272) with some modifications. First, UMI were extracted from each sequencing read and appended to read headers within FASTQ files using a custom script generously provided by D.D. Reads were on-the-fly converted as if all C were non-methylated and mapped to in-silico converted DNA strands of the human genome, also as if all C were non-methylated, using Bowtie2 (Langmead B, Salzberg S. Fast gapped-read alignment with Bowtie 2. Nature Methods. 2012, 9:357-359). Original reads were merged and filtered for single UMI, i.e. reads carrying the same UMI were discarded to exclude duplicate reads. Methylation frequencies were extracted for all CpG markers for which padlock probes were designed. Markers with less than 20 reads in any sample were excluded from analysis. This resulted in ~600 CpG markers for which the methylation level was determined with the accuracy of about 5% or more.

DNA/RNA Isolation and Quantitative PCR

Tumor and corresponding far site samples were obtained from patients undergoing surgical tumor resection; samples were frozen and preserved in at −80° C. until use. Isolation of DNA and RNA from samples was performed using AllPrep DNA/RNA Mini kit (Qiagen, Valencia, Calif.) according to the manufacturer's recommendations, and RNA was subjected to on-column DNase digestion. RNA was quantified using a Nanodrop 2000 (Thermo Scientific). 200 ng RNA of each sample was used for cDNA synthesis using iScript cDNA synthesis kit (Bio-rad, Inc) according to the manufacturer's instructions. qPCR was performed by a standard 40-cycle amplification protocol using gene-specific primers (Table 55) and a Power SYBR Green PCR Master Mix on a 7500 Real Time PCR system (Applied Biosystems). Experiments were carried out in triplicates and normalized to endogenous ACTS levels. Relative fold change in expression was calculated using the $\Delta\Delta CT$ method (cycle threshold values <30). Data are shown as mean±s.d. based on three replicates.

Figure 22:
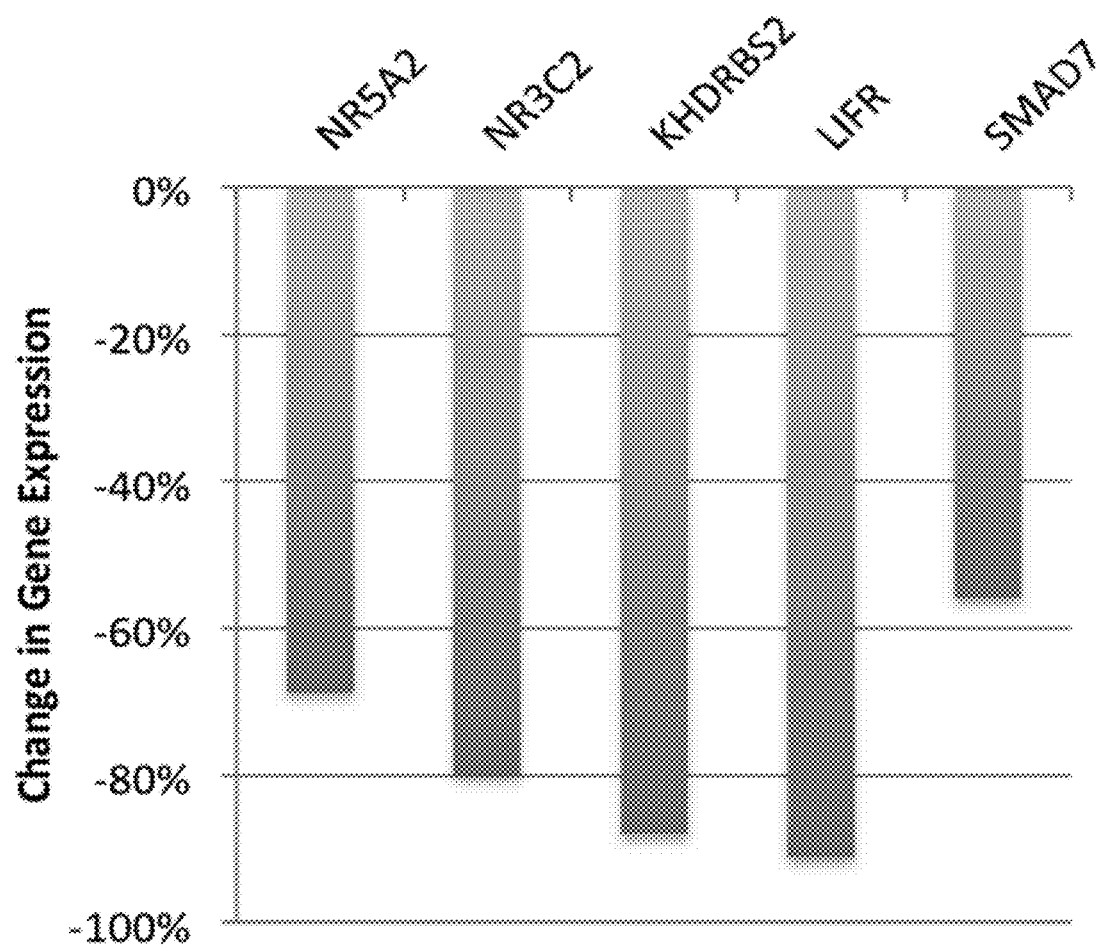
FIG. 22 illustrates mRNA expression of differentially methylated genes in colon cancer determined using qPCR. The mRNA expression in tumor samples was normalized to expression in nearby normal tissue derived from the same patient. Results are shown as average percent change in expression of multiple samples (n=3-7), with each sample performed in 3 technical replicates. All samples were pooled together for statistical analysis using a Wilcoxon sign-rank test to determine whether gene expression changes inversely with methylation, as predicted; p-value on pooled samples was determined to be $1.21 \times 10^{-21}$.
Figure 23E:
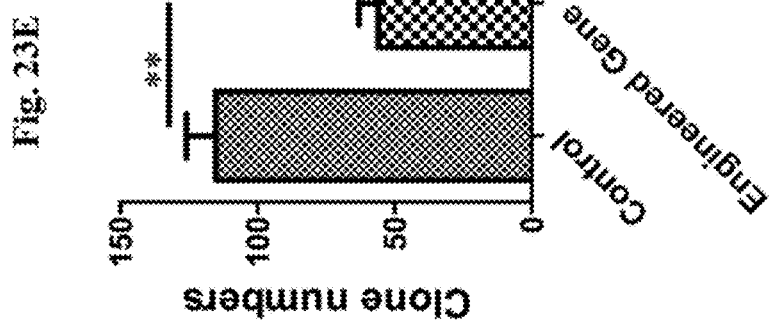
Figure 23D:
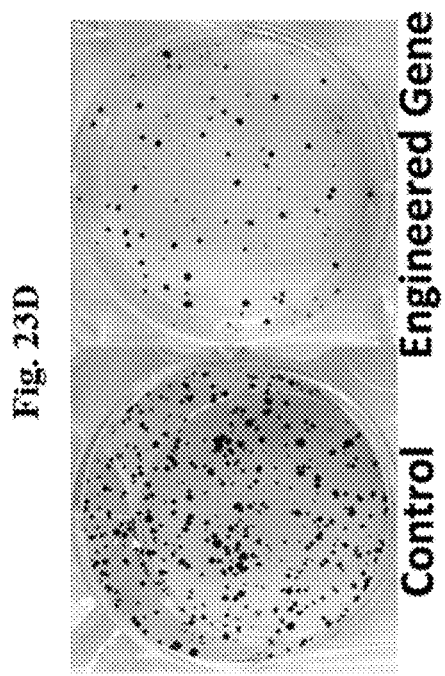

Given that DNA methylation is an essential epigenetic regulator of gene expression, the correlation of differential methylation of sites genes in tumor versus normal tissue with gene expression was investigated in our cohort. Specifically, those methylation sites that predicted the presence of malignancy in the above algorithm were of interest. Top markers which showed hyper-methylation in a cancer type when comparing to that of its matched normal tissue counterpart were selected and their corresponding genes in colon cancer were identified. RNA-seq data from TCGA was utilized as a discovery cohort to calculate differential expression of these genes and the cancer tissue collection as the validation cohort (see FIG. 20 and FIG. 22). A majority of the genes selected exhibited marked CpG hypermethylation relative to normal, and decreased expression was observed in each of these genes. A p-value of $1.21 \times 10^{-21}$ was determined using a Wilcoxon sign-rank test. Importantly, the selected genes are known in be important in carcinogenesis, providing biologic validation of these markers as predictors of malignancy. Not surprisingly, these selected genes, all suppressed, include both known tumor suppressors as well some newly discovered genes. PCDH17 was chosen to test its functional relevance to cancer biology. PCDH17 (cg02994463) is hyper-methylated in colon cancer with conversely decreased gene expression. By a colony formation assay in cell culture and tumor formation assay in nude mice, increased expression of PCDH17 was shown to suppress cancer growth in cell culture and in vivo (FIG. 23).

Cell Line

Human colorectal cancer line DLD-1 was obtained from ATCC. This cell line was transfected to stably express GFP or the desired GFP fusion construct, and FACS sorted to purity. Cells were maintained in DMEM, supplemented with 10% FBS, 1% Penicillin-Streptomycin, and 1% Non-essential amino acids.

Clonogenic Assay Methods.

Cells grown under the above culture condition were trypsinized, and counted using an automatic cell counter. 500 cells were seeded in each well of a 6-well plate and allowed to form colonies. After 7-10 days, cells were fixed in 10% v/v acetic acid/methanol and stained with 0.1% crystal violet. The number of colonies was determined by manual counting from triplicate wells.

Soft Agar Assay

1% noble agar (Gifco) was diluted to 0.5% in 2× culture medium respective for each cell line, with 20% FBS, 2% Pen-Strep, and 2% non-essential amino acids at 42° C. 1.5 mL of the 0.5% agar-culture medium mixture was plated into each well of a 6-well dish and allowed to cool at room temperature for 45 minutes. Cells grown under the above culture conditions were trypsinized, counted using an automatic cell counter, and diluted in 2× culture medium to 4000 cells/mL. 0.6% noble agar was mixed with an equal volume of the diluted cells at 42° C. to a final concentration of 0.3%. 1.5 mL was plated in each well on top of the bottom agar layer, and allowed to cool at room temperature for 45 minutes. The plates were grown at 37° C., and 100 uL media was added twice per week. After 3 weeks, colonies were fixed with 10% v/v acetic acid/methanol and stained with 0.005% crystal violet. The number of colonies was determined by manual counting from triplicate wells for each cell line-construct.

Tumor Xenograft

All animal studies were performed in accordance with institutional and international animal regulations. Animal protocols were approved by the Institutional Animal Care and Use Committee of Sun Yat-Sen University and West China Hospital. Female athymic BALB/c nude mice (4-5 weeks of age, 18-20 g) were purchased from a vendor (Guangdong Province Laboratory Animal Center, Guangzhou, China). Tumor cells were suspended in 100 μl of serum free medium and injected subcutaneously onto the mice. The growth of tumors was monitored every 3 days by examination. Tumor sizes were measured using a caliper, and tumor volume was calculated according to the following equation: tumor volume $(mm^3)$=(length (mm)×width (mm)$^2$)×0.5. After 3-4 weeks, all animals were sacrificed and the xenografts were harvested. Representative data were obtained from five mice per experimental group. Statistical analyses were performed with one-way repeated-measures ANOVA.

Example 6—DNA Methylation Markers in Diagnosis and Prognosis of Common Types of Leukemia Approvals The Cancer Genome Atlas (TCGA) data were downloaded from the TCGA website. This project was approved by the IRB of Guangzhou Women and Children Center, west China hospital. Informed consent was obtained from all patients. Tumor and normal tissues were obtained after patients signed an informed consent.

Characteristics of Patients

Clinical characteristics and molecular profiling including methylation data for a study cohort including 232 AML 161 ALL, and 647 normal blood samples. Clinical characteristics of the patients in study cohorts are listed in Table 54.

TABLE 54

| Characteristic | Training AML (TOGA) | ALL | Testing AML (our data) | NORMAL_BLOOD |
|---|---|---|---|---|
| Clinical characteristics of patients in study cohorts. | | | | |
| Total (n) | 194 | 161 | 38 | 356 |
| Gender | | | | |
| Femal-no. (%) | 90 | 55 | 15 | |
| Male-no. (%) | 104 | 106 | 23 | |
| Age at diagnosis-yr | | | | |
| Mean | 55 | 5.4 | 6.8 | |
| Range | 18-88 | 1-13 | 1-13 | |
| White race-no/total no. (%) | | | | |
| White | 176 | 0 | | |
| Asian | 2 | 161 | | |
| Other | 16 | 0 | | |
| White cell count at diagnosis | | | | |
| Mean | 37.94 ± 30.72 | 8.7 ± 11.78 | | |
| Median | 17 | | | |
| FAB subtype--no. (%) | | | | |
| AML with minimal maturation: M0 | 19 | | 0 | |
| AML without maturation: M1 | 42 | | 1 | |
| AML with maturation: M2 | 43 | | 7 | |
| Acute promyelocytic leukemia: M3 | 19 | | 10 | |
| Acute myelomonocytic leukemia: M4 | 41 | | 4 | |
| Acute monoblastic or monocytic leu | 22 | | 8 | |
| Acute erythroid leukemia: M6 | 3 | | 1 | |
| Acute megakaryoblastic leukemia: M | 3 | | 2 | |
| L1 | | 82 | | |
| L2 | | 41 | | |
| L3 | | 19 | | |
| Other subtype | 2 | 10 | 4 | |
| Cytogenetic risk group-no (%) | | | | |
| Favorable | 36 | 49 | | |
| Intermediate | 110 | 72 | | |
| Unfavorable | 43 | 22 | | |
| Missing data | 3 | 18 | | |
| Immunophenotype-no (%) | | | | |
| CD33+ | 153 | 13 | 24 | |
| CD34+ | 119 | 63 | 16 | |
| TDT | 9 | 30 | 4 | |

Data Sources

DNA methylation data from initial training set and first testing set were obtained from The Cancer Genome Atlas (TCGA). The methylation status of 470,000 sites was generated using the Infinium 450K Methylation Array. DNA methylation data of the second cohort of Chinese cancer patients were obtained using a bisulfite sequencing method.

Calculate Weights for Top Ten Markers in Each Comparison.

Principle component analysis was applied to the top ten markers in each comparison group using the function in the stats environment: prcomp( ) and the weights in the first principle component of each group were extracted and matched with the ten corresponding markers in each group. There were 45 groupings of weights with markers. These markers were used to classify the samples with several algorithms including Neural Networks, Logistic Regression, Nearest Neighbor (NN) and Support Vector Machines (SVM), all of which generated consistent results. Analyses using SVM were found to be most robust and were therefore used in all subsequent analyses.

Classifying Samples

The above mentioned machine learning method was used to classify the ALL, AML and normal blood samples. There are several classification algorithms that were used here including Logistic Regression, Nearest Neighbor (NN) and Support Vector Machines (SVM). All of which generated consistent results. Analysis using SVM were further used in all subsequent analyses.

The Kernel-Based Machine Learning Lab (kernlab) library for R was used to generate the Support Vector Machines. The best results were with the "RBF" kernel. The Crammer, Singer algorithm had slightly better results than the Weston, Watson algorithm. In the analysis, four potential types of classification errors were seen:
1. Incorrect Tissue;
2. False negative; e.g. ALL is identified as normal blood
3. False positive; e.g. normal blood is identified as ALL or AML
4. Correct tissue, incorrect leukemia type; e.g. ALL is identified as AML.

Tumor DNA Extraction

Genomic DNA extraction from pieces of freshly frozen healthy or cancer tissues was performed with QIAamp DNA Mini Kit (Qiagen) according to manufacturer's recommendations. Roughly 0.5 mg of tissue was used to obtain on average 5 μg of genomic DNA. DNA was stored at −20° C. and analyzed within one week of preparation.

Bisulfite Conversion of Genomic DNA

1 μg of genomic DNA was converted to bis-DNA using EZ DNA Methylation-Lightning™ Kit (Zymo Research) according to the manufacturer's protocol. Resulting bis-DNA had a size distribution of ~200-3000 bp, with a peak around ~500-1000 bp. The efficiency of bisulfite conversion was >99.8% as verified by deep-sequencing of bis-DNA and analyzing the ratio of C to T conversion of CH (non-CG) dinucleotides.

Determination of DNA Methylation Levels of the Second Validation Cohort by Deep Sequencing of Bis-DNA Captured with Molecular-Inversion (Padlock) Probes CpG markers whose methylation levels differed in any of the comparison between a cancer tissue and normal tissue were used to design padlock probes for sequencing. Padlock-capture and sequencing of bis-DNA was based on the technique developed by G. Church and colleagues (Porreca G J, Nat Methods. 2007 November; 4 (11):931-6.) and K. Zhang and colleagues (Diep, D Nat Methods. 2012 Feb. 5; 9(3):270-2, Deng, J. et al. Nat. Biotechnol. 27, 353-360 (2009)) with modifications.

Probe Design and Synthesis

Padlock probes were designed using the ppDesigner software. The average length of the captured region was 70 bp, with the CpG marker located in the central portion of the captured region. To prevent bias introduced by unknown methylation status of CpG markers, capturing arms were positioned exclusively within sequences devoid of CG dinucleotides. Linker sequence between arms contained binding sequences for amplification primers separated by a variable stretch of Cs to produced probes of equal length. The average length of probes was 91 bp. Probes incorporated a 6-bp unique molecular identifier (UMI) sequence to allow for the identification of individual molecular capture events and accurate scoring of DNA methylation levels.

Probes were synthesized as separate oligonucleotides using standard commercial synthesis methods. For capture experiments, probes were mixed, in-vitro phosphorylated with T4 PNK (NEB) according to manufacturer's recommendations and purified using P-30 Micro Bio-Spin columns (Bio-Rad).

Bis-DNA Capture 20 ng of bisulfite-converted DNA was mixed with a defined molar ratio of padlock probes in 20 μl reactions containing 1× Ampligase buffer (Epicentre). The optimal molar ratio of probes to DNA was determined experimentally to be 20,000:1. Reactions were covered with 50 μl of mineral oil to prevent evaporation. To anneal probes to DNA, 30 second denaturation at 95° C. was followed by a slow cooling to 55° C. at a rate of 0.02° C. per second. Hybridization was left to complete for 15 hrs at 55° C. To fill gaps between annealed arms, 5 μl of the following mixture was added to each reaction: 2 U of PfuTurboCx polymerase (pre-activated for 3 min at 95° C. (Agilent)), 0.5 U of Ampligase (Epicentre) and 250 pmol of each dNTP in 1× Ampligase buffer. After 5 hour incubation at 55° C., reactions were denatured for 2 minutes at 94° C. and snap-cooled on ice. 5 μl of exonuclease mix (20 U of Exo I and 100 U of ExoIII, both from Epicentre) was added and single-stranded DNA degradation was carried out at 37° C. for 2 hours, followed by enzyme inactivation for 2 minutes at 94° C.

Circular products of site specific capture were amplified by PCR with concomitant barcoding of separate samples. Amplification was carried out using primers specific to linker DNA within padlock probes, one of which contained specific 6 bp barcodes. Both primers contained Illumina next-generation sequencing adaptor sequences. PCR was done as follows: 1x Phusion Flash Master Mix, 3 μl of captured DNA and 200 nM final [c] of primers, using the following cycle: 10 s @ 98° C., 8× of (1 s @ 98° C., 5 s @ 58° C., 10 s @ 72° C.), 25× of (1 s @ 98° C., 15 s @ 72° C.), 60 s @ 72° C. PCR reactions were mixed and the resulting library was size selected to include effective captures (~230 bp) and exclude "empty" captures (~150 bp) using Agencourt AMPure XP beads (Beckman Coulter). Purity of the libraries was verified by PCR using Illumina flowcell adaptor primers (P5 and P7) and the concentrations were determined using Qubit dsDNA HS assay (Thermo Fisher). Libraries we sequenced using MiSeq and HiSeq2500 systems (Illumina).

Optimization of Capture Coverage Uniformity

Deep sequencing of the original pilot capture experiments showed significant differences between number of reads captured by most efficient probes and non-efficient probes (60-65% of captured regions with coverage >0.2 of average). To ameliorate this, relative efficiencies were calculated from sequencing data and probes were mixed at adjusted molar ratios. This increased capture uniformity to 85% of regions at >0.2 of average coverage.

Sequencing Data Analysis

Mapping of sequencing reads was done using the software tool with some modifications. First, UMI were extracted from each sequencing read and appended to read headers within FASTQ files using a custom script generously provided by D.D. Reads were on-the-fly converted as if all C were non-methylated and mapped to in-silico converted DNA strands of the human genome, also as if all C were non-methylated, using Bowtie2. Original reads were merged and filtered for single UMI, i.e. reads carrying the same UMI were discarded leaving a single one. Methylation frequencies were extracted for all CpG markers for which padlock probes were designed. Markers with less than 20 reads in any sample were excluded from analysis. This resulted in ~600 CpG markers for which the methylation level was determined with the accuracy of 5% or more.

Figure 24:
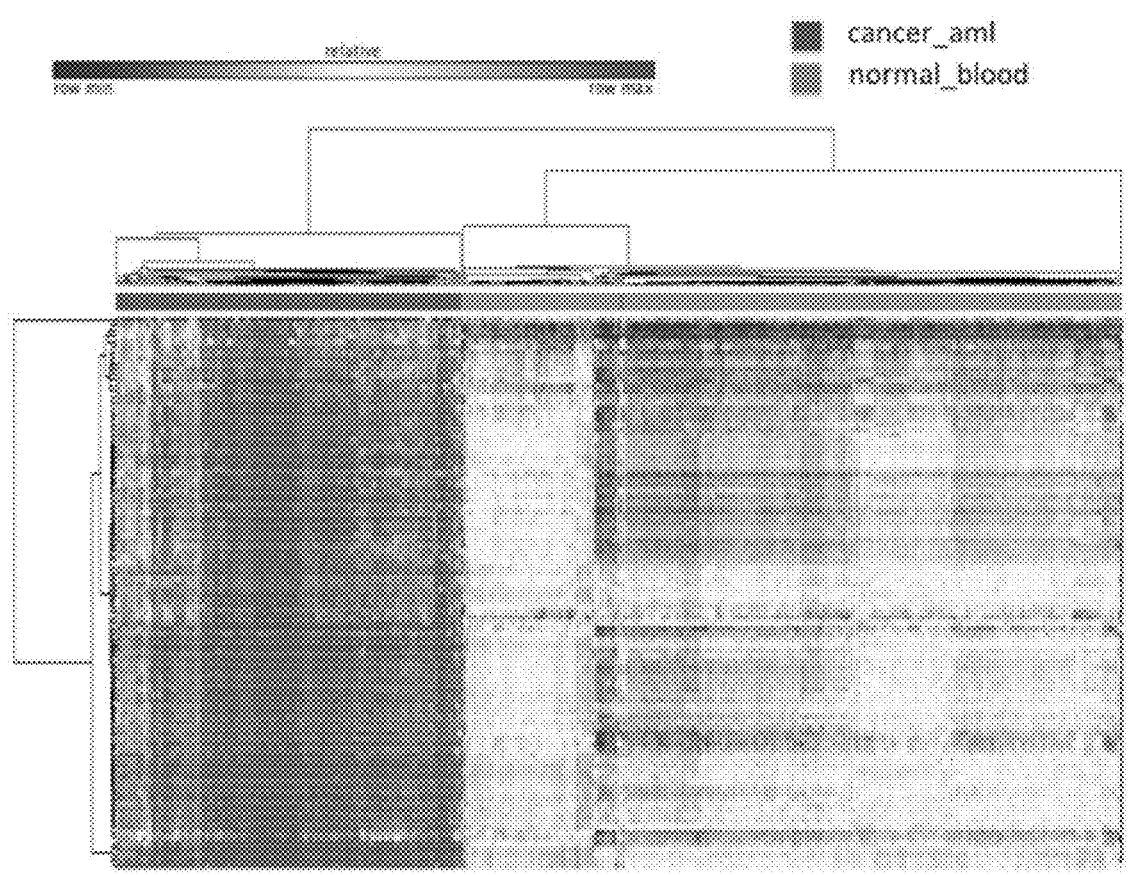
FIG. 24 illustrates unsupervised hierarchical clustering and heat map associated with the methylation profile in AML vs normal blood.
Figure 25:
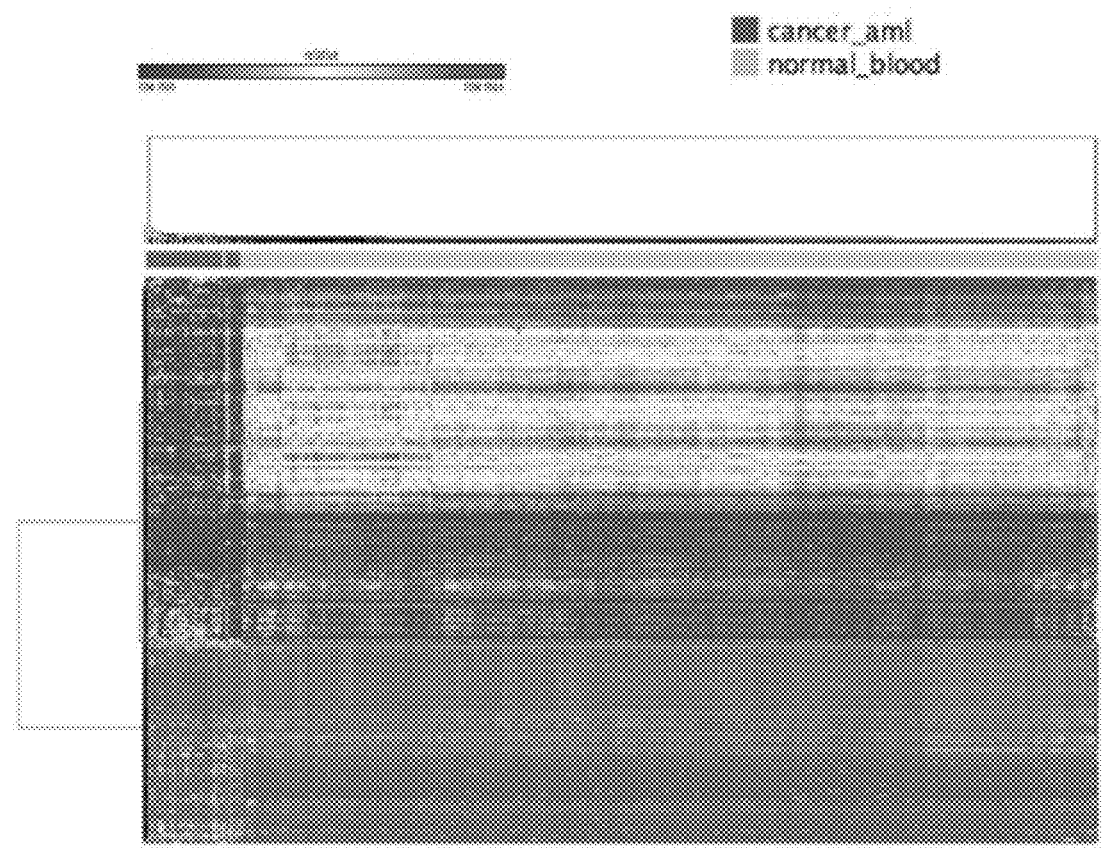
FIG. 25 illustrates unsupervised hierarchical clustering and heat maps associated with the methylation profile in AML versus normal blood samples in a replication cohort.
Figure 26:
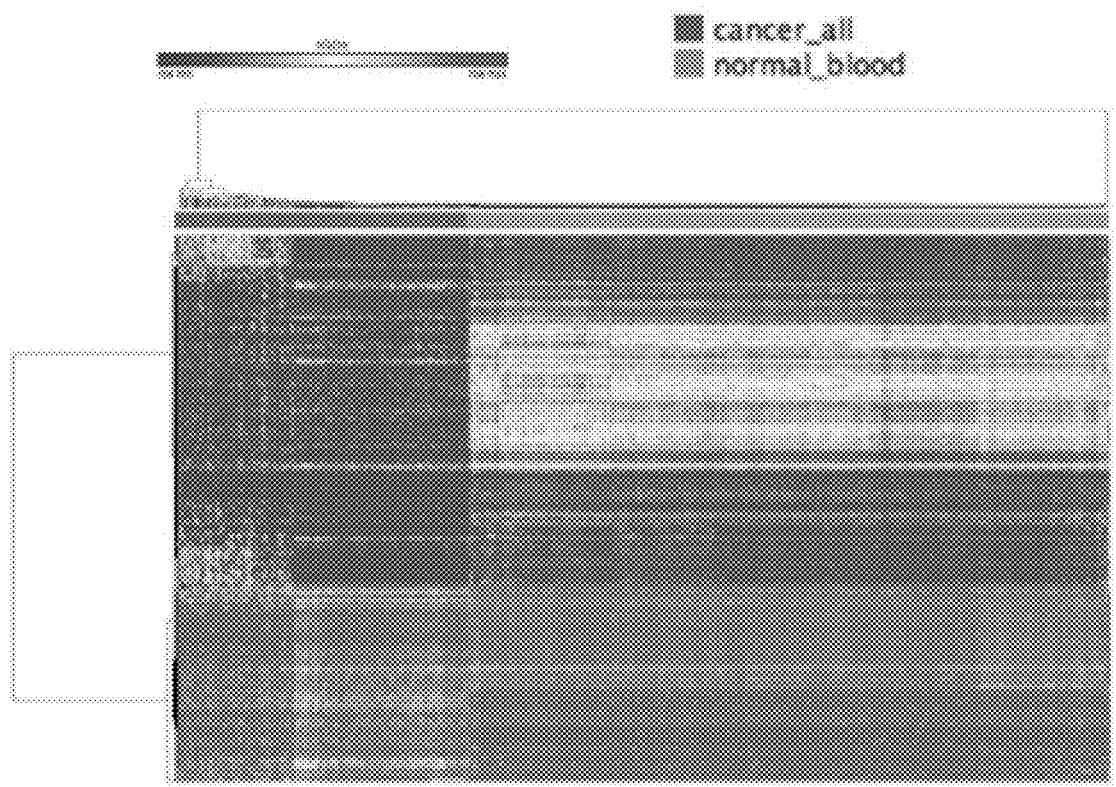
FIG. 26 illustrates unsupervised hierarchical clustering and heat maps associated with the methylation profile (according to the color scale shown) in ALL versus normal blood samples.

Genome Wide Methylation Profiling Identified Specific Methylation Signatures in Leukemia To identify a leukemic-type specific signature, whole genome methylation differences between ALL or AML versus normal blood samples was compared in a pair-wise fashion. CpG markers with greatest methylation differences were ranked. These 50 top-ranked CpG sites were plotted in an unsupervised fashion in AML versus normal blood samples (FIG. 24). AML was differentiated from normal blood samples (FIG. 24, Table 55A). The finding was further replicated in a Chinese AML cohort (FIG. 25 and Table 55C). Similarly, ALL were differentiated from normal blood samples (FIG. 26, Table 55B). Taken together, these data demonstrated differential methylation of CpG sites was able to distinguish a particular leukemia type from normal blood with specificity and sensitivity (Table 55). Overall sensitivity was about 98% and specificity was about 97%. Overall, these results demonstrate the robust nature of these methylation patterns in identifying the presence of a particular type of leukemia.

TABLE 55A

TCGA training Cohort

| Training Cohort | AML | Normal Blood | Totals |
|---|---|---|---|
| AML | 192 | 6 | |
| Normal Blood | 2 | 140 | |
| Totals | 194 | 146 | 340 |
| Correct | 192 | 140 | 332 |
| False Positive | 0 | 6 | 0 |
| False Negative | 2 | 0 | 0 |
| Wrong Tissue | 0 | 0 | 0 |
| Specificity (%) | | 95.9 | 97.3 |
| Sensitivity (%) | 99.0 | | 97.7 |

TABLE 55B

TCGA testing Cohort.

| Testing Cohort1 | AML | Normal Blood | Totals |
|---|---|---|---|
| AML | 40 | 5 | |
| Normal Blood | 0 | 140 | |
| Totals | 40 | 145 | 185 |
| Correct | 40 | 140 | 180 |
| False Positive | 0 | 5 | 0 |
| False Negative | 0 | 0 | 0 |
| Wrong Tissue | 0 | 0 | 0 |
| Specificity (%) | | 96.6 | 97.3 |
| Sensitivity (%) | 100 | | 100 |

TABLE 55C

Chinese leukemia cohorts.

| Testing Cohort2 | ALL | AML | Normal Blood | Totals |
|---|---|---|---|---|
| ALL | 158 | 2 | 0 | |
| AML | 1 | 36 | 0 | |
| ALL/AML | 2 | 0 | 0 | |
| Normal Blood | 0 | 0 | 356 | |
| Totals | 161 | 38 | 356 | 555 |
| Correct | 158 | 36 | 356 | 550 |
| False Positive | 0 | 0 | 0 | 0 |
| False Negative | 0 | 0 | 0 | 0 |
| Wrong Tissue | 3 | 2 | 0 | 17 |
| Specificity (%) | | | | 100 |
| Sensitivity (%) | 98.1 | 94.8 | 100 | 97.5 |

Methylation Profiles can Distinguish Between Different Leukemia

Figure 27:
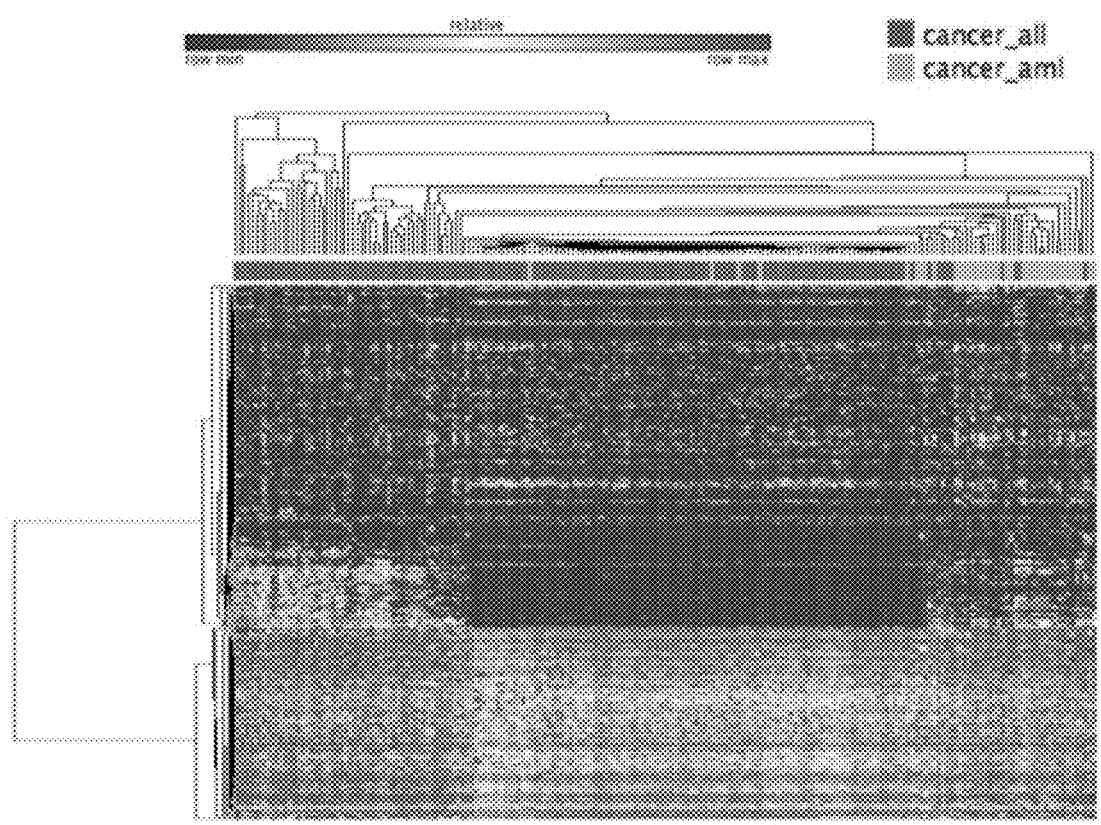
FIG. 27 illustrates methylation profile can differentiate subtype of leukemia. Hierarchical clustering and heat map associated with ALL, AML cancer types.

The method has the ability to distinguish between a particular type of leukemia and normal blood samples, therefore, the ability of the algorithm to distinguish different types of leukemic cancers (ALL and AML) arising from bone marrow for ALL and AML was investigated (Table 55C). Each tumor subtype was distinguished with greater than 90% sensitivity and specificity (FIG. 27). Together, these results demonstrate the efficacy of using methylation patterns for accurate cancer diagnosis of a histological subtype.

Methylation Profiles Predict Prognosis and Survival Rates

Figure 28A:
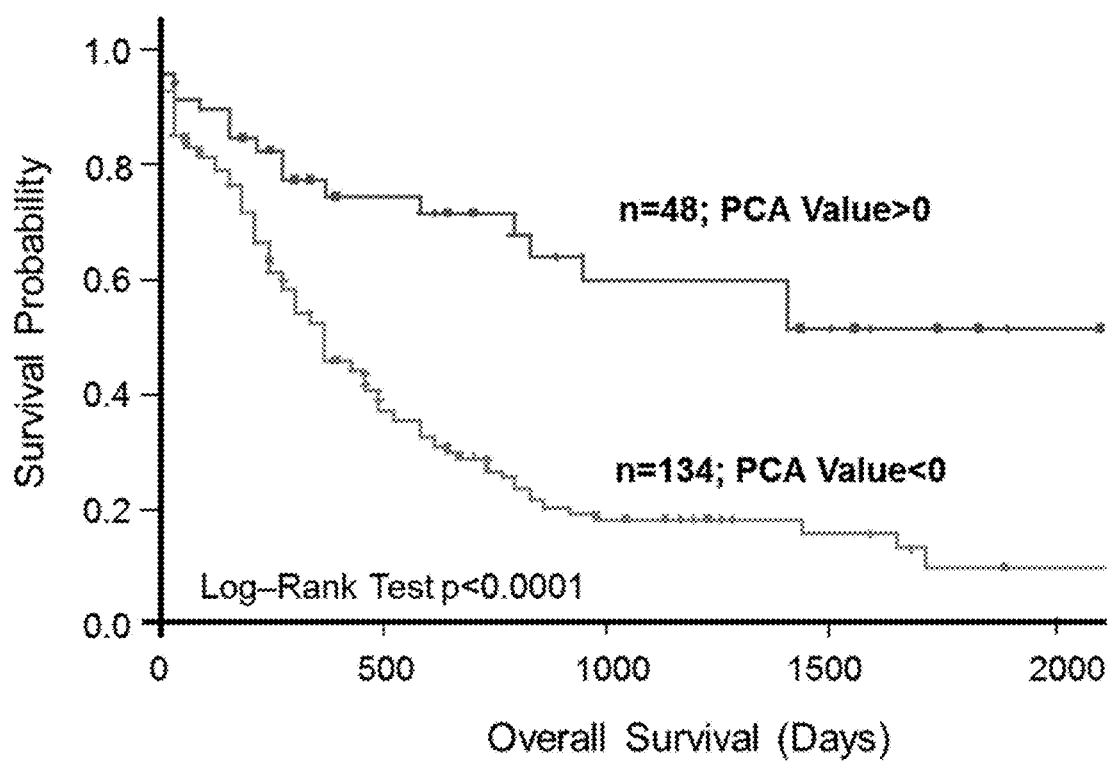
FIG. 28A-FIG. 28B illustrates methylation markers profiles.
Figure 28B:
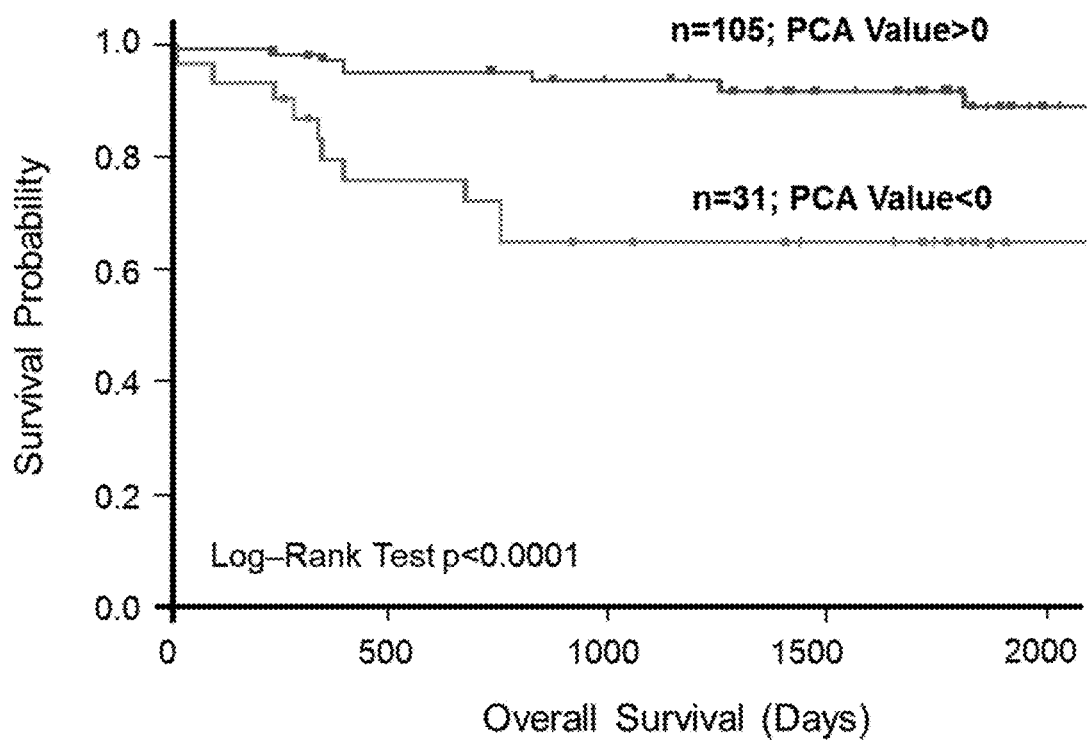

Each leukemia subtype (AML and ALL) was analyzed using principle component analysis (PCA) to identify a methylation signature that predicted survival (specifically, alive vs dead at 5 years from diagnosis). For each leukemic type, samples were divided into two groups based on the resulting methylation signatures and their survival was plotted using a Kaplan-Meier curve (FIG. 28). These methylation profiles were able to predict highly significant differences in survival in ALL and AML.

Example 7—Analysis of Tissue and Cell Free DNA Sample by Digital Droplet PCR

Cell Free DNA Sample Process

Plasma samples were centrifuged at 1500 g for 5 min at 4° C. to remove cell debris. After centrifugation, lymphocyte cell free DNA (cfDNA) was extracted from the supernatant using a QIAamp Blood DNA Mini Kit (Qiagent) according to the manufacturer's protocol.

Genomic DNA was converted to bis-DNA using EZ DNA Methylation-Lightning™ Kit (Zymo Research) according to the manufacturer's protocol. The bis-DNA was further quantified using the Qubit™ ssDNA assay kit.

Genomic DNA Sample Process from Tumor Tissues

Genomic DNA extraction from pieces of freshly frozen healthy or cancer tissues was performed with QIAamp DNA Mini Kit (Qiagen) according to manufacturer's recommendations. Roughly 0.5 mg of tissue was used to obtain on average 5 μg of genomic DNA. DNA was stored at −20° C. and analyzed within one week of preparation.

1 μg of genomic DNA was converted to bis-DNA using EZ DNA Methylation-Lightning™ Kit (Zymo Research) according to the manufacturer's protocol. Resulting bis-DNA had a size distribution of ~200-3000 bp, with a peak around ~500-1000 bp.

Droplet Digital PCR (ddPCR)

Droplet digital PCR (ddPCR) was performed using the QX200™ Droplet Digital PCR system according to the manufacturer's recommendations (Bio-Rad). The ddPCR was performed with Bio-Rad's recommended two-step thermo-cycling protocol. The sequences of the primers and probes are illustrated in Table 58-59. About 1 ng to about 20 ng of bis-DNA sample was used for each reaction with about 0.4-0.8 μM of forward and reverse primers and about 0.2 μM of each probe. Data analysis was performed using QuantaSoft (Bio-Rad).

Methylation Profiling Differentiates Cancer Types and Cancer Subtypes

Figure 29:
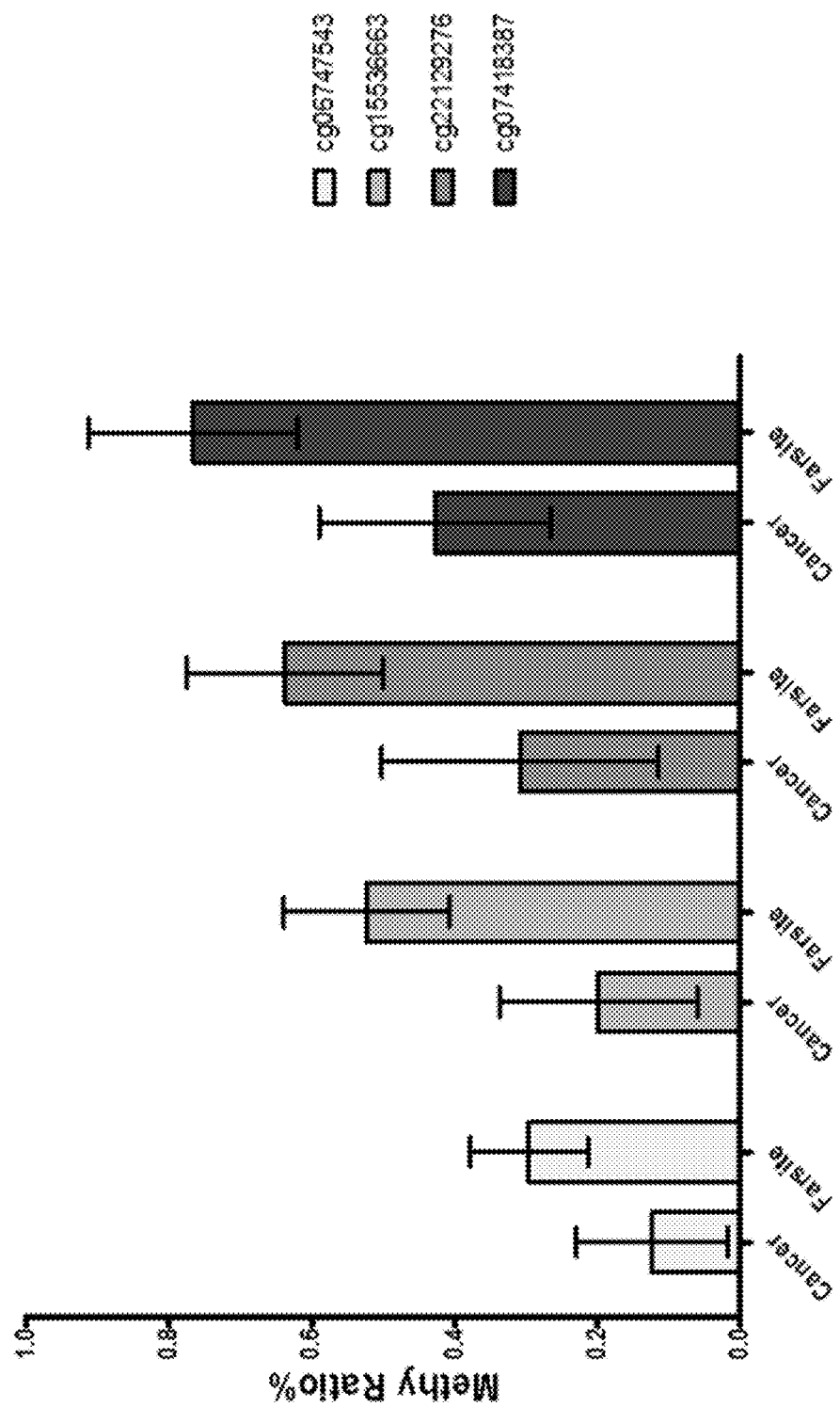
FIG. 29 illustrates the methylation ratios of four exemplary CpG sites (cg06747543, cg15536663, cg22129276, and cg07418387) in both colon cancer tissue and normal colon tissue sample (Farsite).
Figure 30:
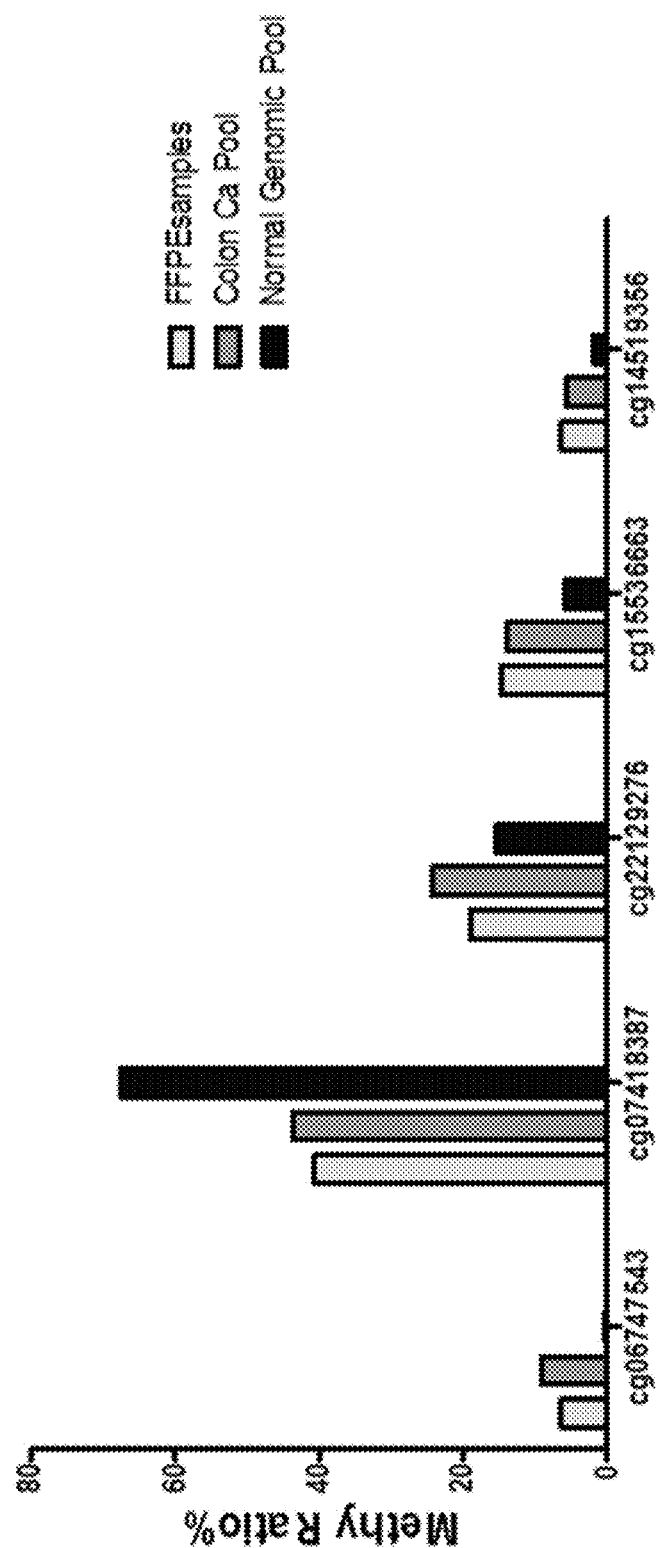
FIG. 30 illustrates the methylation ratios of five exemplary CpG sites in metastatic colon cancer tissue sample, primary colon cancer reference sample, and normal lymphocyte genomic DNA reference sample.

The methylation ratios of four exemplary CpG sites (cg06747543, cg15536663, cg22129276, and cg07418387) in both colon cancer tissue and normal colon tissue sample (Farsite) are illustrated in FIG. 29. Each bar represents an average of 24 samples. These four CpG sites along with CpG site cg14519356 were further analyzed in colon cancer tissue samples that have metastasized to the lung. FIG. 30 illustrates the methylation ratios of these five CpG sites in metastatic colon cancer tissue sample, primary colon cancer reference sample, and normal lymphocyte genomic DNA reference sample. The methylation ratios of cg15536663 and cg14519356 are similar in comparison between the metastatic colon cancer samples to their respective primary colon cancer reference samples. However, the methylation ratios of cg06747543, cg22129276, and cg07418387 differ in comparison between the metastatic colon cancer samples to their respective primary colon cancer reference samples. Similarly, the methylation ratios of these five CpG sites also differ in comparison between the metastatic colon cancer samples to their respective normal lymphocyte genomic DNA reference samples. The methylation ratios of the five CpG sites indicate a different methylation pattern between metastatic colon cancer, primary colon cancer, and normal lymphocyte sample.

Figure 31A:
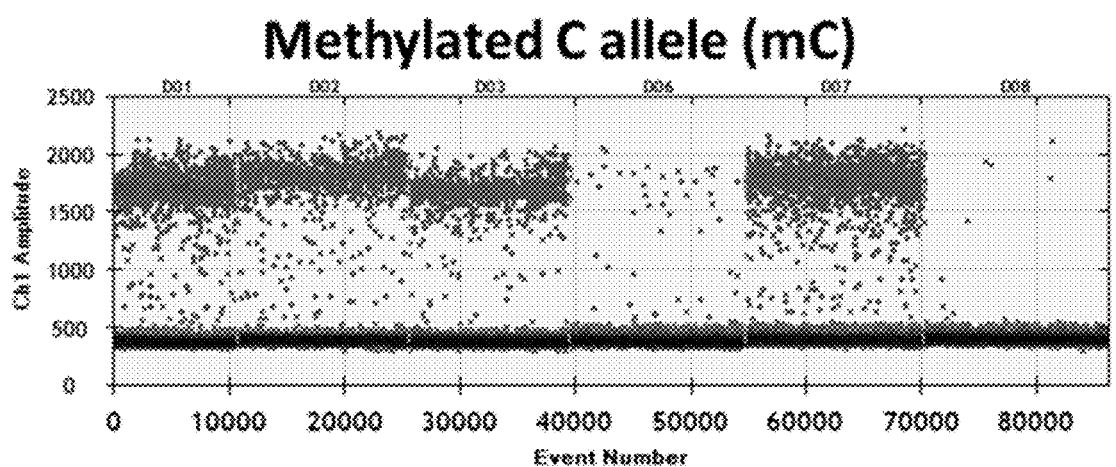
FIG. 31A-FIG. 31C show the methylation signatures from cell-free DNA (cfDNA) samples derived from colon cancer.
Figure 31B:
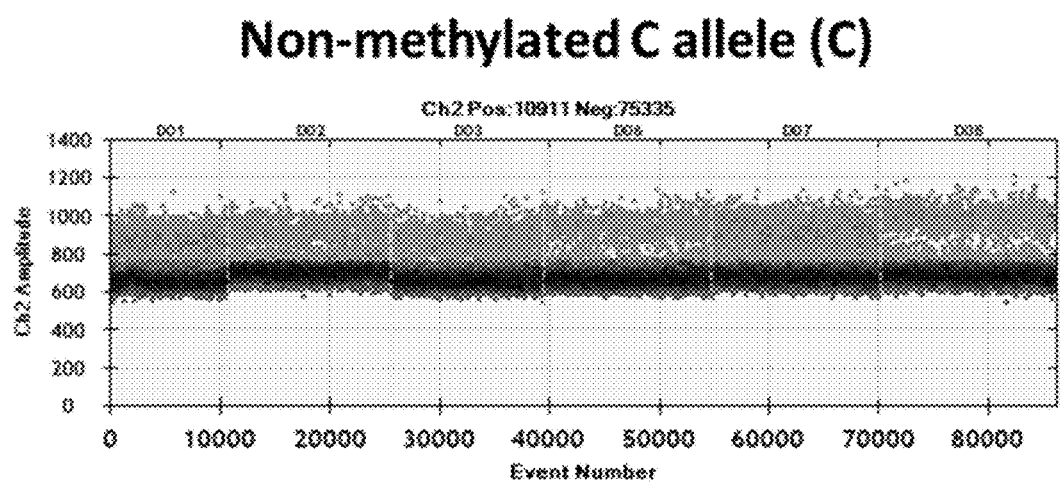
Figure 31C:
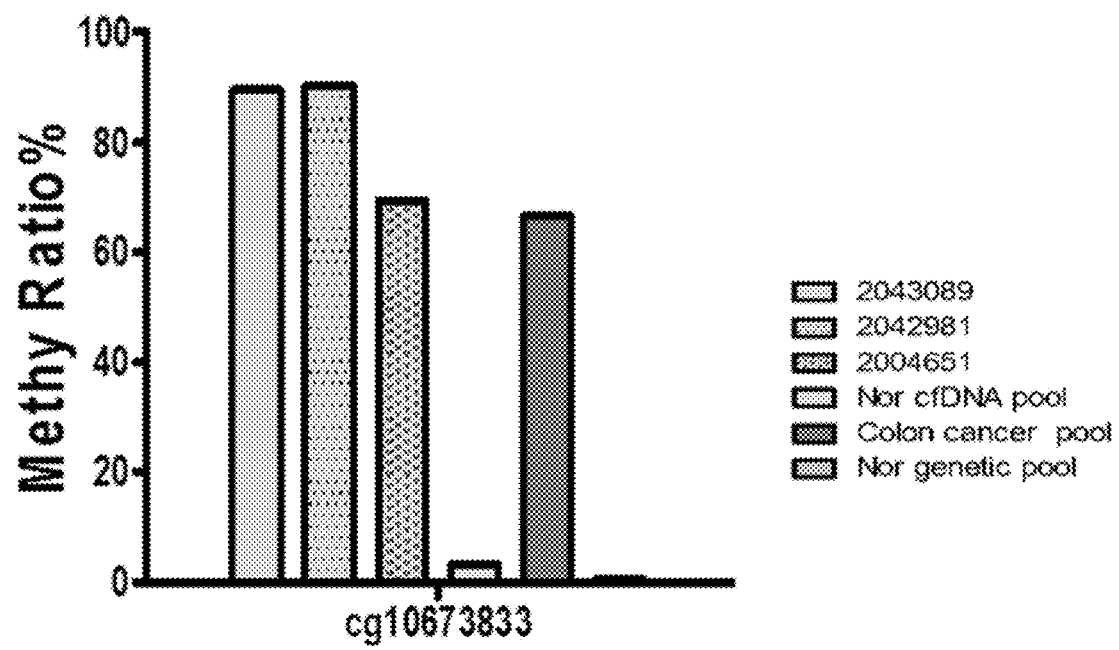

The methylation signatures from cell-free DNA (cfDNA) samples derived from colon cancer are illustrated in FIG. 31A-FIG. 31C. FIG. 31A shows the methylated regions of genomic cfDNA and FIG. 31B illustrates the non-methylated regions of the genomic cfDNA. FIG. 31C illustrates the methylation ratios of CpG site cg10673833 from three patients (2043089, 2042981, and 2004651), normal cfDNA reference sample, primary colon tissue reference sample, and normal blood reference sample. Patients 2043089 and 2042981 have primary colon cancer, and Patient 2004651 has metastatic colon cancer.

Figure 32A:
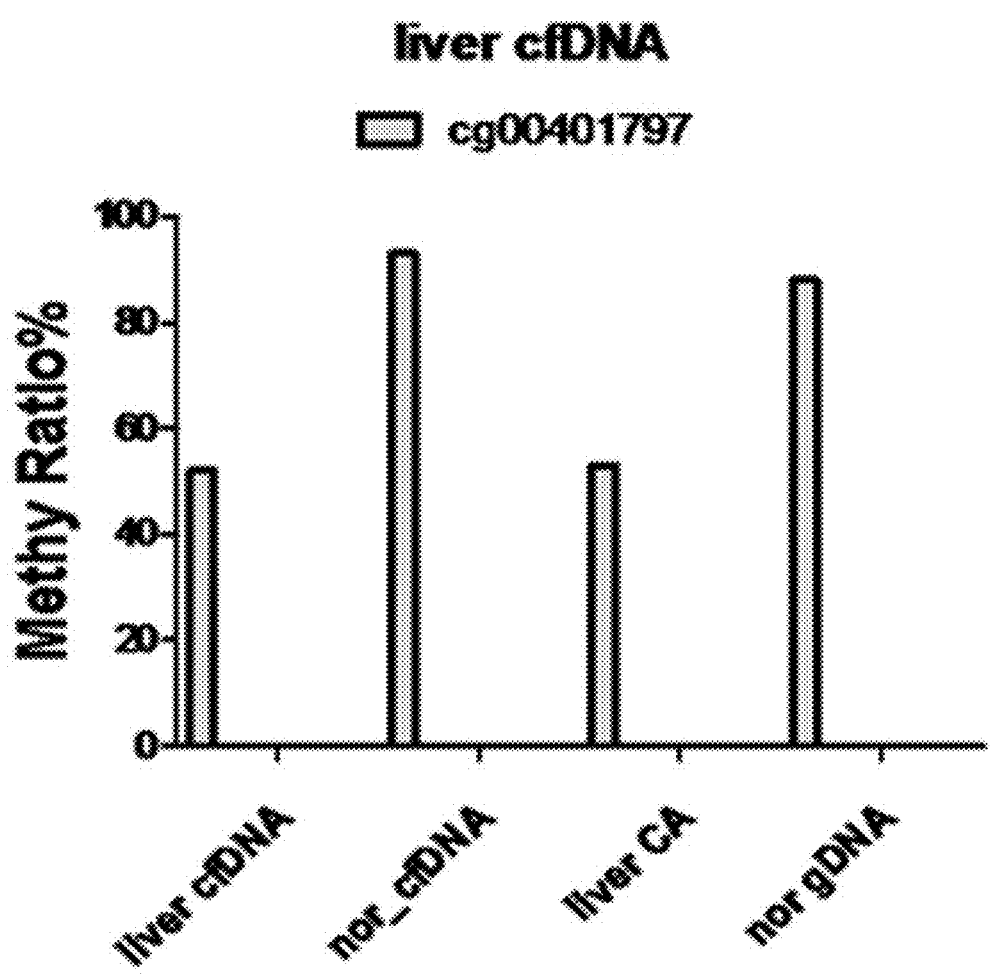
FIG. 32A-FIG. 32C show the methylation profiles for primary liver, breast, and lung cancers.
Figure 32B:
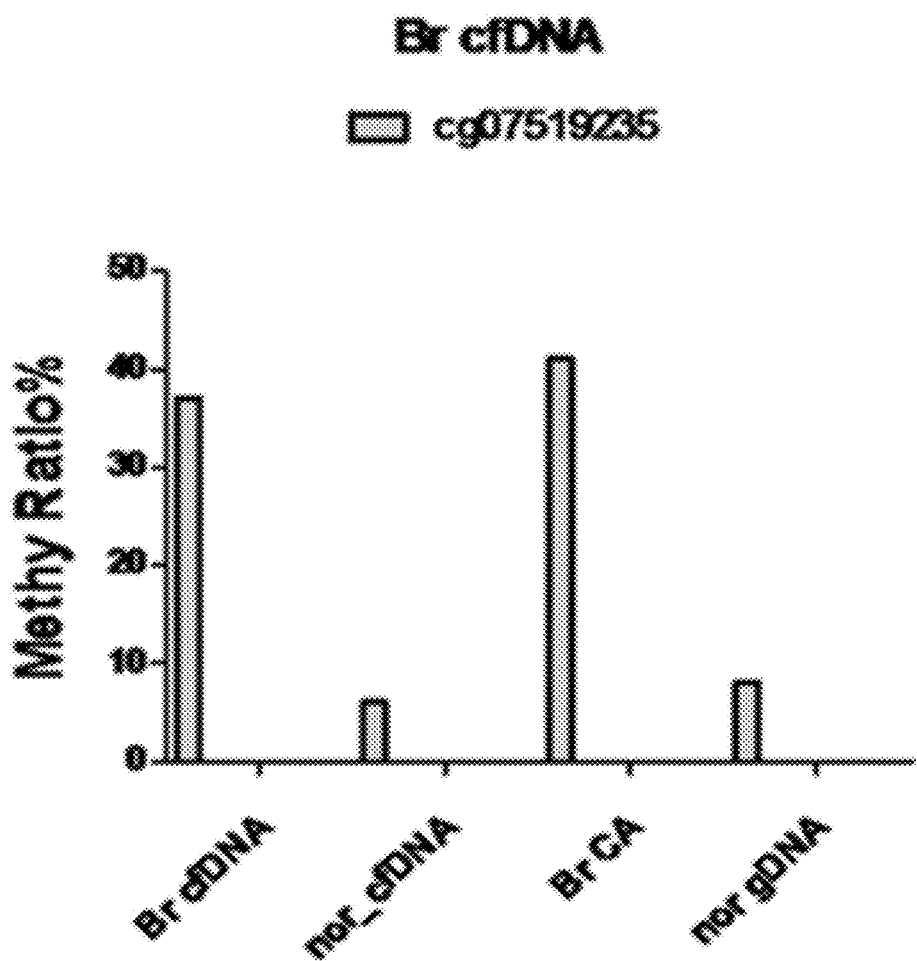
Figure 32C:
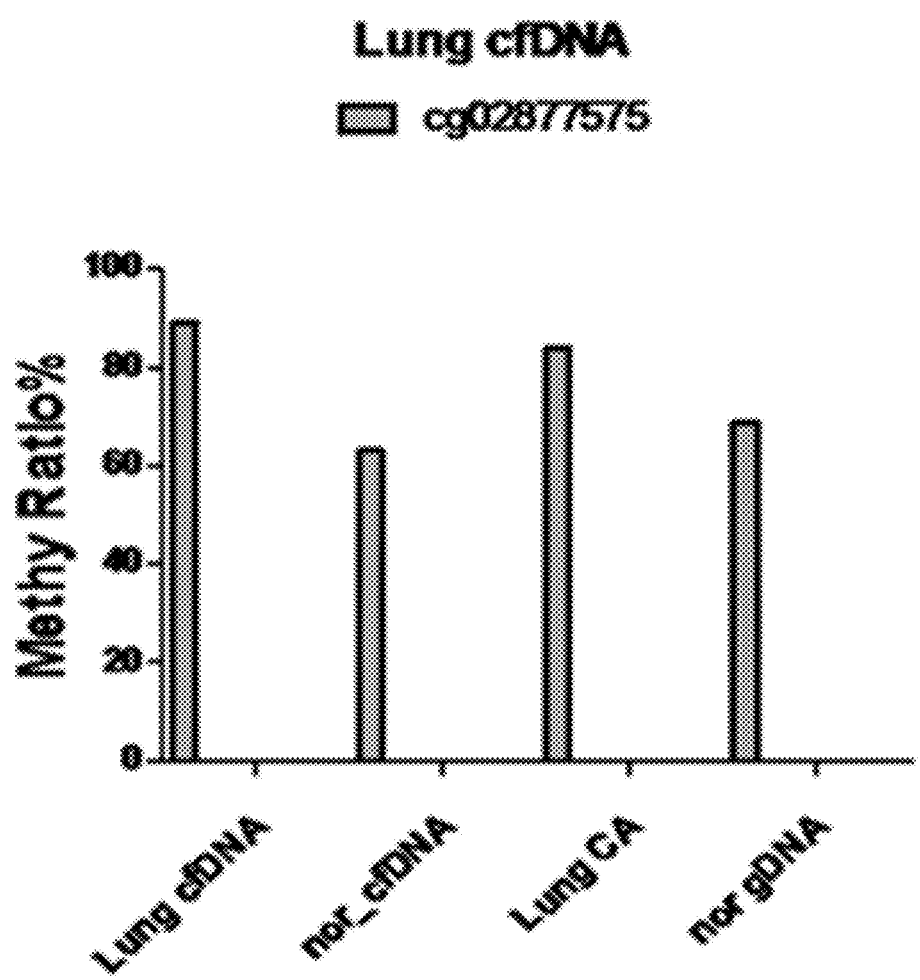

The methylation profiles for primary liver, breast, and lung cancers are illustrated in FIG. 32A-FIG. 32C. FIG. 32A shows the methylation ratio of CpG site cg00401797 in liver cancer cfDNA sample, normal cfDNA sample, primary liver cancer tissue reference sample (genomic DNA), and normal lymphocyte reference sample (genomic DNA). FIG. 32B shows the methylation ratio of CpG site cg07519236 in breast cancer cfDNA sample, normal cfDNA sample, primary breast cancer tissue reference sample (genomic DNA), and normal lymphocyte reference sample (genomic DNA). FIG. 32C shows the methylation ratio of CpG site cg02877575 in lung cancer cfDNA sample, normal cfDNA sample, primary lung cancer tissue reference sample (genomic DNA), and normal lymphocyte reference sample (genomic DNA).

Figure 33A:
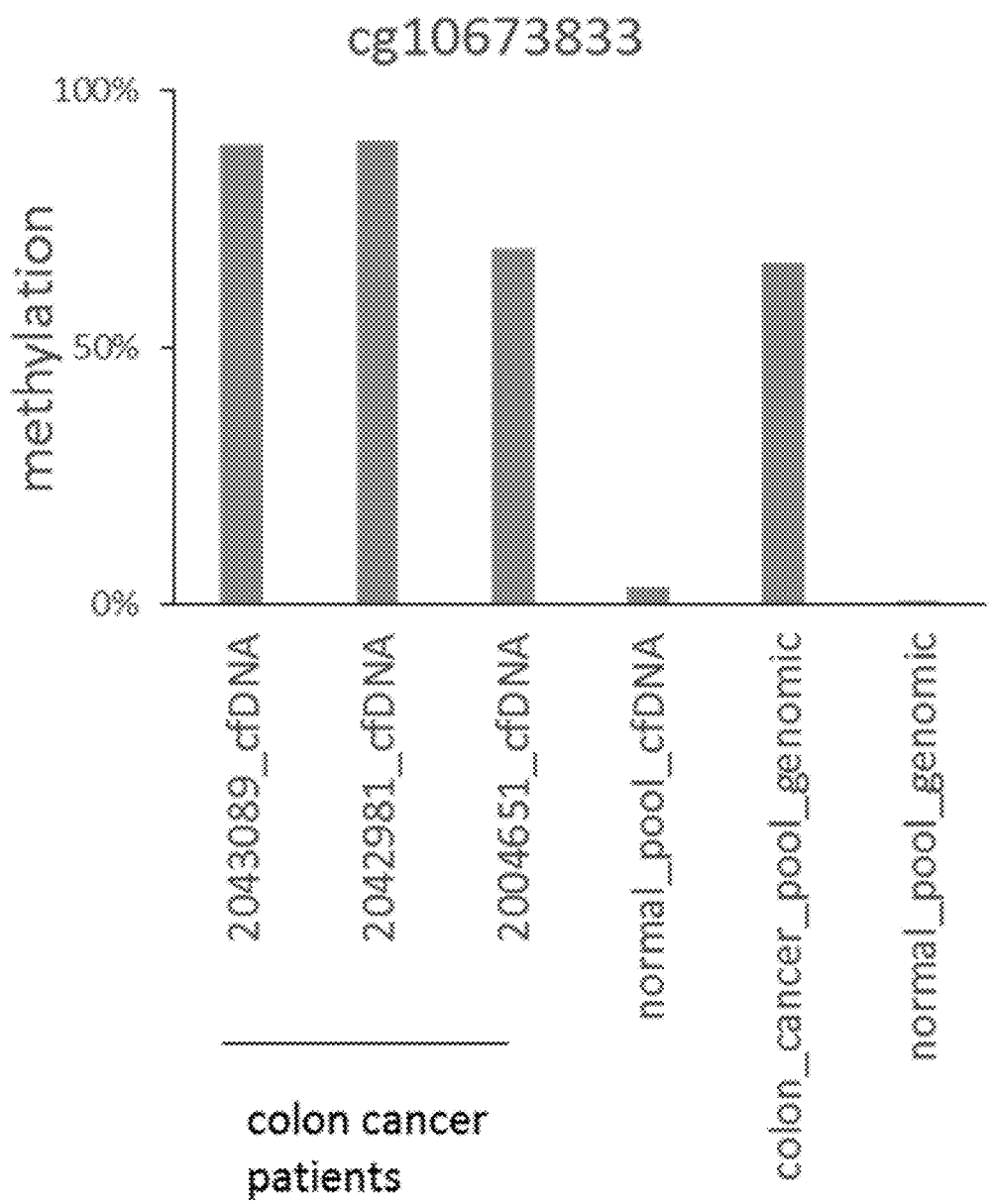
FIG. 33A-FIG. 33B show two different probes that differentiate primary colon cancer from normal sample.
Figure 33B:
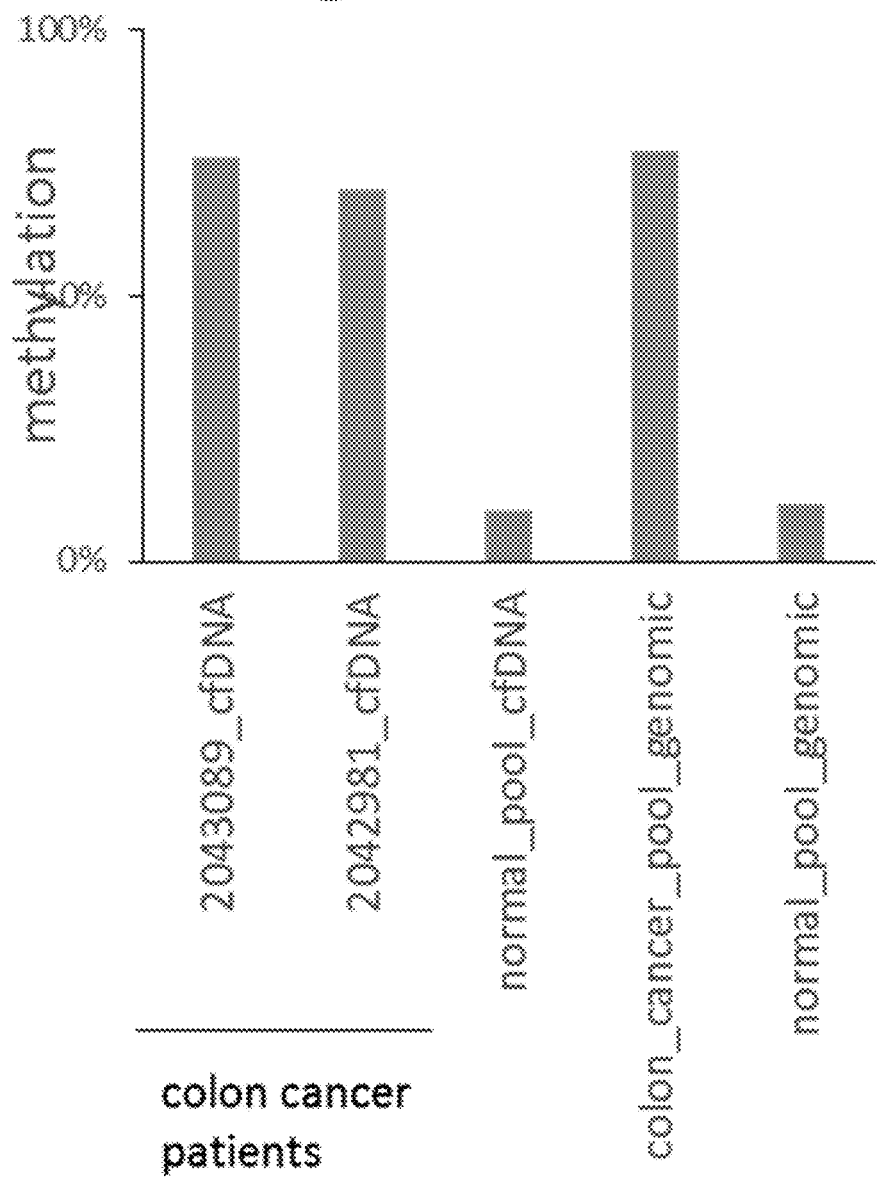
Figure 34A:
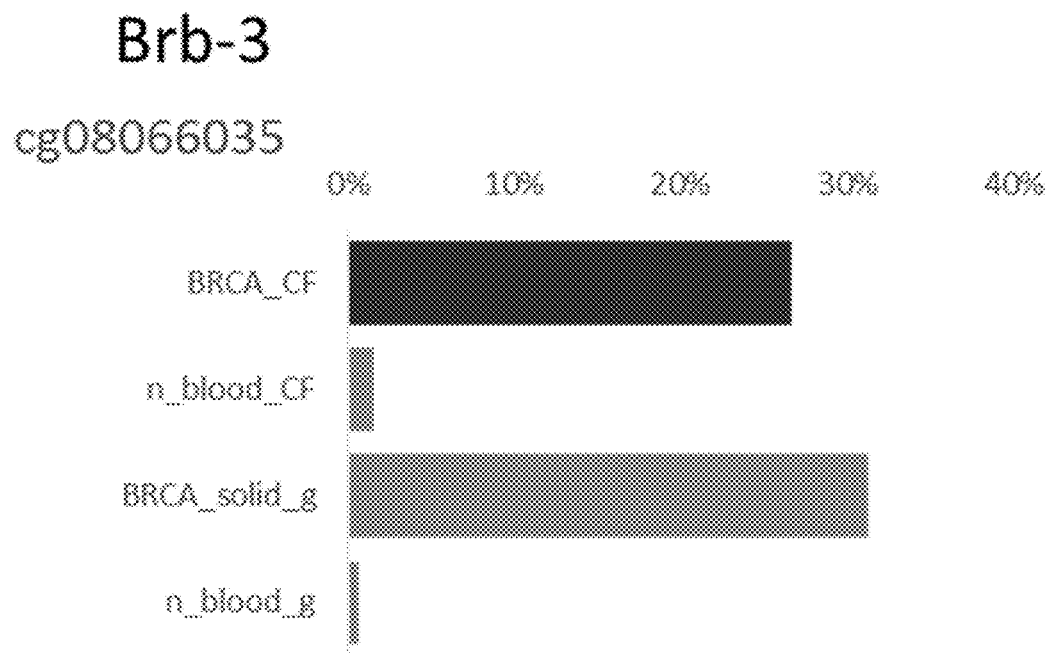
FIG. 34A-FIG. 34D show the analysis of cfDNA from breast cancer patients. Four probes were used: Brb-3 (FIG. 34A), Brb-4 (FIG. 34B), Brb-8 (FIG. 34C), and Brb-13 (FIG. 34D). The methylation ratio of cfDNA primary breast cancer was compared to normal cfDNA sample, primary breast cancer tissue reference sample (genomic DNA), and normal lymphocyte reference sample (genomic DNA).
Figure 34B:
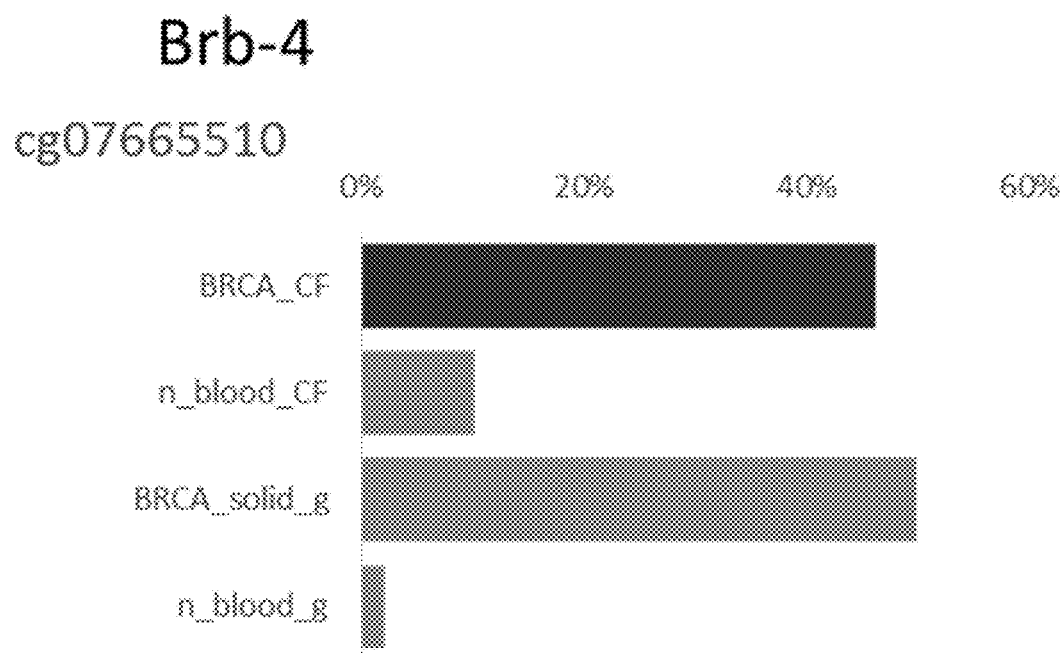
Figure 34C:
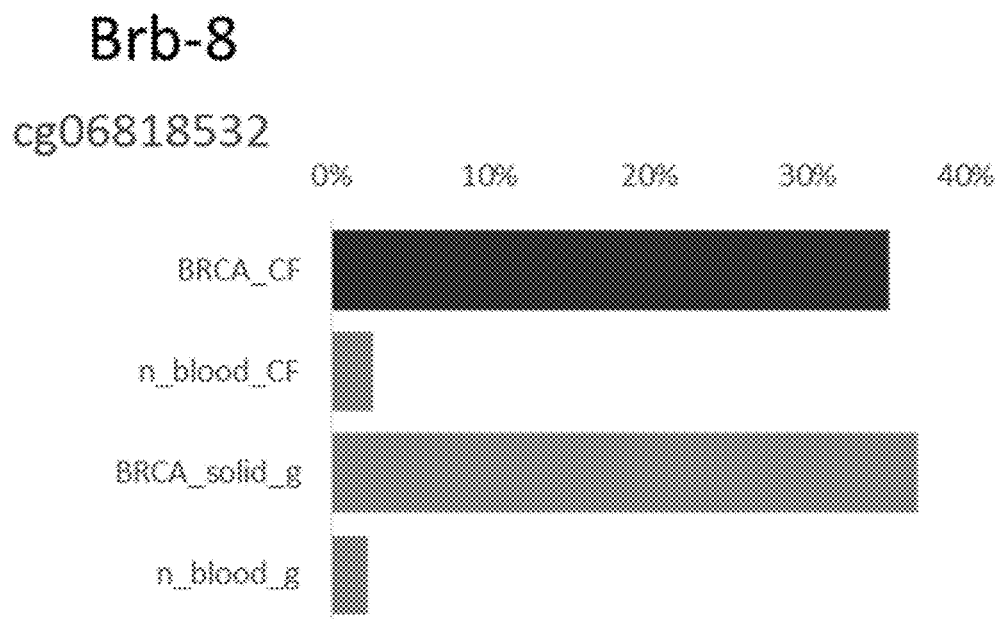
Figure 34D:
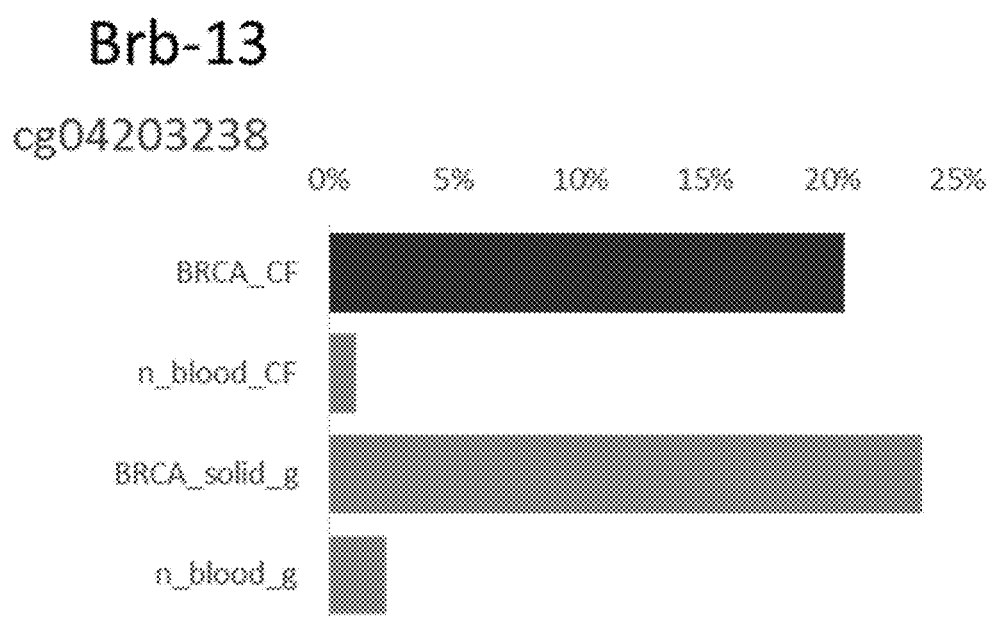

FIG. 33 shows two different probes that differentiate primary colon cancer from normal sample. FIG. 33A shows probe Cob-2 which targets the CpG site cg10673833 and the methylation profiles from the cfDNA samples of three colon cancer patients, normal cfDNA sample, primary colon cancer tissue reference sample (genomic DNA), and normal lymphocyte reference sample (genomic DNA). Two of the three patients (2043089 and 2042981) have primary colon cancer. The remainder patient (2004651) has metastatic colon cancer. The methylation ratio of cg10673833 differs in comparison between cfDNA primary colon cancer sample and cfDNA metastatic colon cancer sample; while the methylation ratios between the cfDNA metastatic colon cancer sample and primary colon cancer tissue reference sample are similar. FIG. 33B shows probe Brb-2 which targets the CpG site cg07974511 and the methylation profiles from the cfDNA samples of two primary colon cancer patients (2043089 and 2042981), normal cfDNA sample, primary colon cancer tissue reference sample (genomic DNA), and normal lymphocyte reference sample (genomic DNA). At the CpG site cg07974511, the methylation ratios between cfDNA colon cancer sample and primary colon cancer tissue reference sample are similar but differ from the methylation ratios of normal cfDNA sample and normal lymphocyte reference sample (genomic DNA).

FIG. 34 shows the analysis of cfDNA from breast cancer patients. Four probes were used (Brb-3, Brb-4, Brb-8, and Brb-13). The methylation ratio of cfDNA primary breast cancer was compared to normal cfDNA sample, primary breast cancer tissue reference sample (genomic DNA), and normal lymphocyte reference sample (genomic DNA). All four probes were able to detect the presence of breast cancer in cfDNA samples.

Figure 35A:
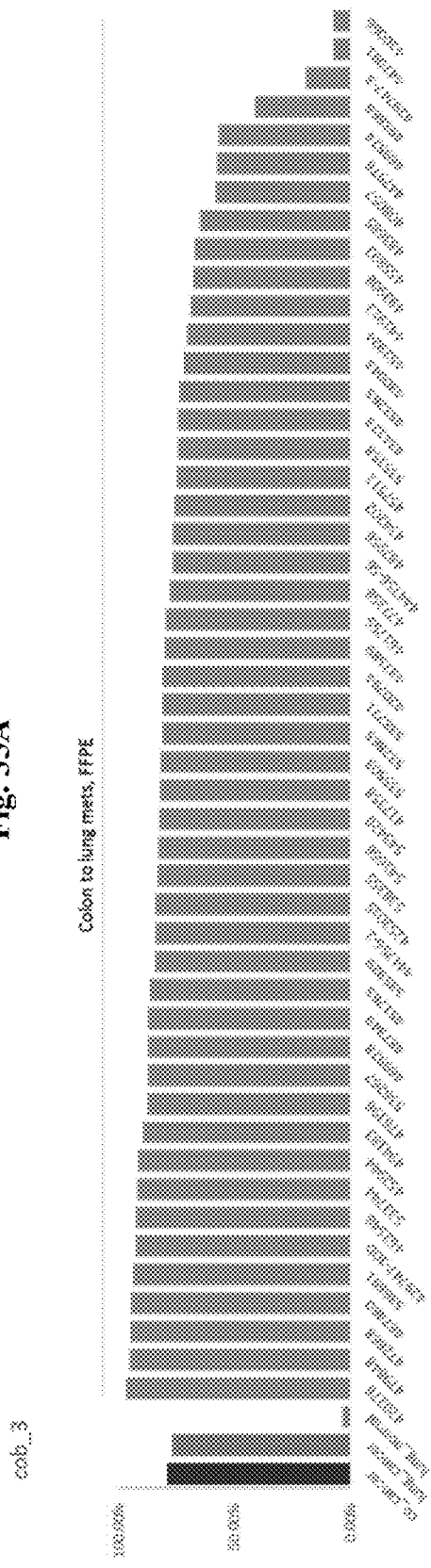
FIG. 35A-FIG. 35B show detection of metastatic colon cancer in the tissue samples of 49 patients from two probes, Cob_3 and brb_13.
Figure 35B:
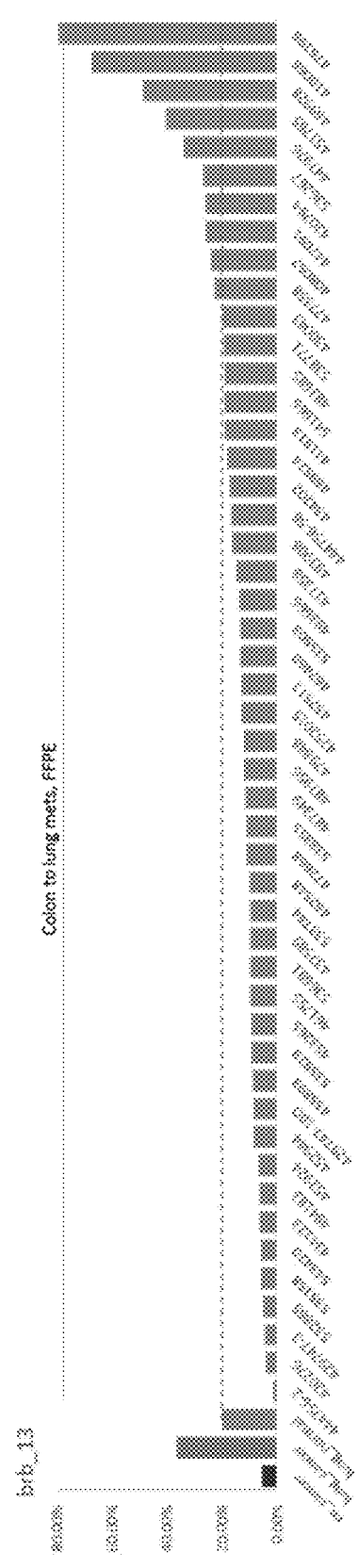

FIG. 35A and FIG. 35B show that two probes, Cob_3 and brb_13, each is able to detect metastatic colon cancer in the tissue samples of 49 patients. FIG. 35A shows the methylation profile of 49 patients in comparison with a colon cancer tissue reference sample, lung cancer tissue reference sample, and normal lung tissue reference sample, using the Cob_3 probe. The methylation ratios of about 47 out of 49 patients were higher in comparison with the methylation ratio of the normal lung tissue reference sample. In FIG. 35B which used the brb_13 probe, about 30 out of 49 patients had lower methylation ratios in comparison with the methylation ratio of the normal lung tissue reference sample.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

---

Lengthy table referenced here

US09984201-20180529-T00001

Please refer to the end of the specification for access instructions.

---

Lengthy table referenced here

US09984201-20180529-T00002

Please refer to the end of the specification for access instructions.

---

Lengthy table referenced here

US09984201-20180529-T00003

Please refer to the end of the specification for access instructions.

---

Lengthy table referenced here

US09984201-20180529-T00004

Please refer to the end of the specification for access instructions.

---

Lengthy table referenced here

US09984201-20180529-T00005

Please refer to the end of the specification for access instructions.

---

Lengthy table referenced here

US09984201-20180529-T00006

Please refer to the end of the specification for access instructions.

Lengthy table referenced here
US09984201-20180529-T00007

Please refer to the end of the specification for access instructions.

Lengthy table referenced here
US09984201-20180529-T00008

Please refer to the end of the specification for access instructions.

Lengthy table referenced here
US09984201-20180529-T00009

Please refer to the end of the specification for access instructions.

Lengthy table referenced here
US09984201-20180529-T00010

Please refer to the end of the specification for access instructions.

Lengthy table referenced here
US09984201-20180529-T00011

Please refer to the end of the specification for access instructions.

Lengthy table referenced here
US09984201-20180529-T00012

Please refer to the end of the specification for access instructions.

Lengthy table referenced here
US09984201-20180529-T00013

Please refer to the end of the specification for access instructions.

Lengthy table referenced here
US09984201-20180529-T00014

Please refer to the end of the specification for access instructions.

Lengthy table referenced here
US09984201-20180529-T00015

Please refer to the end of the specification for access instructions.

Lengthy table referenced here
US09984201-20180529-T00016

Please refer to the end of the specification for access instructions.

Lengthy table referenced here
US09984201-20180529-T00017

Please refer to the end of the specification for access instructions.

Lengthy table referenced here
US09984201-20180529-T00018

Please refer to the end of the specification for access instructions.

Lengthy table referenced here
US09984201-20180529-T00019

Please refer to the end of the specification for access instructions.

Lengthy table referenced here
US09984201-20180529-T00020

Please refer to the end of the specification for access instructions.

Lengthy table referenced here
US09984201-20180529-T00021

Please refer to the end of the specification for access instructions.

Lengthy table referenced here
US09984201-20180529-T00022

Please refer to the end of the specification for access instructions.

Lengthy table referenced here
US09984201-20180529-T00023

Please refer to the end of the specification for access instructions.

Lengthy table referenced here
US09984201-20180529-T00024

Please refer to the end of the specification for access instructions.

| Lengthy table referenced here |
| --- |
| US09984201-20180529-T00025 |
| Please refer to the end of the specification for access instructions. |

| Lengthy table referenced here |
| --- |
| US09984201-20180529-T00026 |
| Please refer to the end of the specification for access instructions. |

| Lengthy table referenced here |
| --- |
| US09984201-20180529-T00027 |
| Please refer to the end of the specification for access instructions. |

| Lengthy table referenced here |
| --- |
| US09984201-20180529-T00028 |
| Please refer to the end of the specification for access instructions. |

| Lengthy table referenced here |
| --- |
| US09984201-20180529-T00029 |
| Please refer to the end of the specification for access instructions. |

| Lengthy table referenced here |
| --- |
| US09984201-20180529-T00030 |
| Please refer to the end of the specification for access instructions. |

| Lengthy table referenced here |
| --- |
| US09984201-20180529-T00031 |
| Please refer to the end of the specification for access instructions. |

| Lengthy table referenced here |
| --- |
| US09984201-20180529-T00032 |
| Please refer to the end of the specification for access instructions. |

| Lengthy table referenced here |
| --- |
| US09984201-20180529-T00033 |
| Please refer to the end of the specification for access instructions. |

| Lengthy table referenced here |
| --- |
| US09984201-20180529-T00034 |
| Please refer to the end of the specification for access instructions. |

| Lengthy table referenced here |
| --- |
| US09984201-20180529-T00035 |
| Please refer to the end of the specification for access instructions. |

| Lengthy table referenced here |
| --- |
| US09984201-20180529-T00036 |
| Please refer to the end of the specification for access instructions. |

| Lengthy table referenced here |
| --- |
| US09984201-20180529-T00037 |
| Please refer to the end of the specification for access instructions. |

| Lengthy table referenced here |
| --- |
| US09984201-20180529-T00038 |
| Please refer to the end of the specification for access instructions. |

| Lengthy table referenced here |
| --- |
| US09984201-20180529-T00039 |
| Please refer to the end of the specification for access instructions. |

| Lengthy table referenced here |
| --- |
| US09984201-20180529-T00040 |
| Please refer to the end of the specification for access instructions. |

| Lengthy table referenced here |
| --- |
| US09984201-20180529-T00041 |
| Please refer to the end of the specification for access instructions. |

| Lengthy table referenced here |
| --- |
| US09984201-20180529-T00042 |
| Please refer to the end of the specification for access instructions. |

LENGTHY TABLES

The patent contains a lengthy table section. A copy of the table is available in electronic form from the USPTO web site (http://seqdata.uspto.gov/?pageRequest=docDetail&DocID=US09984201B2). An electronic copy of the table will also be available from the USPTO upon request and payment of the fee set forth in 37 CFR 1.19(b)(3).

SEQUENCE LISTING (2321 sequences)

SEQ ID NO: 1 - DNA, 118 bp, Artificial Sequence
  Description of Artificial Sequence: Synthetic polynucleotide
  modified_base (92)..(97): a, c, t, g, unknown or other
tccaacttttctccccacctctcacgttggaggctcatcgttcctattcccccccccccccccccccaggcagatgttatcgaggtccgacnnnnnntcaacatcttaaatacaacaa

SEQ ID NO: 2 - DNA, 118 bp, Artificial Sequence
  Description of Artificial Sequence: Synthetic polynucleotide
  modified_base (92)..(97): a, c, t, g, unknown or other
tcataatcttcctactactaaccacgttggaggctcatcgttcctattcccccccccccccccccccaggcagatgttatcgaggtccgacnnnnnnaactttacttctactactacc

SEQ ID NO: 3 - DNA, 118 bp, Artificial Sequence
  Description of Artificial Sequence: Synthetic polynucleotide
  modified_base (91)..(96): a, c, t, g, unknown or other
acccacaacaaatctacaaccccgttggaggctcatcgttcctattccccccccccccccccccccaggcagatgttatcgaggtccgacnnnnnnaatataaacacaccaaaaaccc

SEQ ID NO: 4 - DNA, 118 bp, Artificial Sequence
  Description of Artificial Sequence: Synthetic polynucleotide
  modified_base (87)..(92): a, c, t, g, unknown or other
tcctctttttaaaactctcgttggaggctcatcgttcctattccccccccccccccccccccaggcagatgttatcgaggtccgacnnnnnnaaataaacaaaataccctccccaatt

SEQ ID NO: 5 - DNA, 118 bp, Artificial Sequence
  Description of Artificial Sequence: Synthetic polynucleotide
  modified_base (97)..(102): a, c, t, g, unknown or other
tcctaataacttcctcttcaacaaccgttggaggctcatcgttcctattcccccccccccccccccccccccaggcagatgttatcgaggtccgacnnnnnnttcctaccccctaaaa

SEQ ID NO: 6 - DNA, 118 bp, Artificial Sequence
  Description of Artificial Sequence: Synthetic polynucleotide
  modified_base (92)..(97): a, c, t, g, unknown or other
ccataaacctactataaacacgttggaggctcatcgttcctattcccccccccccccccccccccccaggcagatgttatcgaggtccgacnnnnnnacacacaaaaatatttatctt

SEQ ID NO: 7 - DNA, 118 bp, Artificial Sequence
  Description of Artificial Sequence: Synthetic polynucleotide
  modified_base (91)..(96): a, c, t, g, unknown or other
actccactttactaattaatttacacacatcagttggaggctcatcgttcctattcccccccccccaggcagatgttatcgaggtccgacnnnnnnatcccaatttactatatctcct

SEQ ID NO: 8 - DNA, 118 bp, Artificial Sequence
  Description of Artificial Sequence: Synthetic polynucleotide
  modified_base (93)..(98): a, c, t, g, unknown or other
ccttacatacccaacacgttggaggctcatcgttcctattccccccccccccccccccccccccccccaggcagatgttatcgaggtccgacnnnnnntctctaaacaaaccaaattt

SEQ ID NO: 9 - DNA, 118 bp, Artificial Sequence
  Description of Artificial Sequence: Synthetic polynucleotide
  modified_base (87)..(92): a, c, t, g, unknown or other
acttctaactcccctaactcccatccccgttggaggctcatcgttcctattcccccccccccaggcagatgttatcgaggtccgacnnnnnnacctaaacctaaacacaatcactttt

SEQ ID NO: 10 - DNA, 118 bp, Artificial Sequence
  Description of Artificial Sequence: Synthetic polynucleotide
  modified_base (81)..(86): a, c, t, g, unknown or other
atacccacctatcaaccccacctacgttggaggctcatcgttcctattccccccccaggcagatgttatcgaggtccgacnnnnnnaaaaccccctccctatctttaaaactaatttc

SEQ ID NO: 11 - DNA, 118 bp, Artificial Sequence
  Description of Artificial Sequence: Synthetic polynucleotide
  modified_base (93)..(98): a, c, t, g, unknown or other
ccacactaccataacaacagttggaggctcatcgttcctattccccccccccccccccccccccccccaggcagatgttatcgaggtccgacnnnnnnaaaaattctcctctcctcct

SEQ ID NO: 12 - DNA, 118 bp, Artificial Sequence
  Description of Artificial Sequence: Synthetic polynucleotide
  modified_base (93)..(98): a, c, t, g, unknown or other
acaacaactccctccacgttggaggctcatcgttcctattccccccccccccccccccccccccccccaggcagatgttatcgaggtccgacnnnnnntctatctcctcctctctcca

SEQ ID NO: 13 - DNA, 118 bp, Artificial Sequence
  Description of Artificial Sequence: Synthetic polynucleotide
  modified_base (91)..(96): a, c, t, g, unknown or other
aaaaccacacaaacccctgttggaggctcatcgttcctattcccccccccccccccccccccccccaggcagatgttatcgaggtccgacnnnnnnaaactctaaaaacacaacaaaa

SEQ ID NO: 14 - DNA, 118 bp, Artificial Sequence
  Description of Artificial Sequence: Synthetic polynucleotide
  modified_base (86)..(91): a, c, t, g, unknown or other
actcctcctcccctacctccgttggaggctcatcgttcctattccccccccccccccccccaggcagatgttatcgaggtccgacnnnnnnaaaaatttaaaacaactccactaatta

SEQ ID NO: 15 - DNA, 118 bp, Artificial Sequence
  Description of Artificial Sequence: Synthetic polynucleotide
  modified_base (92)..(97): a, c, t, g, unknown or other
ctaaaaataacccaaatattttaagttggaggctcatcgttcctattccccccccccccccccccccaggcagatgttatcgaggtccgacnnnnnnaaacattctattaactcaaca

SEQ ID NO: 16 - DNA, 118 bp, Artificial Sequence
  Description of Artificial Sequence: Synthetic polynucleotide
  modified_base (93)..(98): a, c, t, g, unknown or other
actaaaaaccaacacaaacacacgttggaggctcatcgttcctattccccccccccccccccccccccaggcagatgttatcgaggtccgacnnnnnntttcctaaacatacaaacaa

SEQ ID NO: 17 - DNA, 118 bp, Artificial Sequence
  Description of Artificial Sequence: Synthetic polynucleotide
  modified_base (90)..(95): a, c, t, g, unknown or other
actatcacttcttcctcttcttattatccgttggaggctcatcgttcctattcccccccccccccaggcagatgttatcgaggtccgacnnnnnntttttaccacaaaataaaaacct

SEQ ID NO: 18 - DNA, 118 bp, Artificial Sequence
  Description of Artificial Sequence: Synthetic polynucleotide
  modified_base (91)..(96): a, c, t, g, unknown or other
acctccaattcttttatttatttcttttaaaagttggaggctcatcgttcctattcccccccccccaggcagatgttatcgaggtccgacnnnnnnttccccataaccccaataacta

SEQ ID NO: 19 - DNA, 118 bp, Artificial Sequence
  Description of Artificial Sequence: Synthetic polynucleotide
  modified_base (93)..(98): a, c, t, g, unknown or other
actccacacaccatcctctaacttattacagttggaggctcatcgttcctattcccccccccccccccaggcagatgttatcgaggtccgacnnnnnnataatcccaaatccctttct

SEQ ID NO: 20 - DNA, 118 bp, Artificial Sequence
  Description of Artificial Sequence: Synthetic polynucleotide
  modified_base (93)..(98): a, c, t, g, unknown or other
tctttcctctctctactaacacaaacgttggaggctcatcgttcctattcccccccccccccccccccaggcagatgttatcgaggtccgacnnnnnntcttcaaaatacaaaacact

SEQ ID NO: 21 - DNA, 118 bp, Artificial Sequence
  Description of Artificial Sequence: Synthetic polynucleotide
  modified_base (84)..(89): a, c, t, g, unknown or other
accaccaactactaaacccctatcgttggaggctcatcgttcctattccccccccccccaggcagatgttatcgaggtccgacnnnnnnaccataaaattcaataactatttaaaaat

SEQ ID NO: 22 - DNA, 118 bp, Artificial Sequence
  Description of Artificial Sequence: Synthetic polynucleotide
  modified_base (87)..(92): a, c, t, g, unknown or other
ctaccacctcctcaacgttggaggctcatcgttcctattcccccccccccccccccccccccaggcagatgttatcgaggtccgacnnnnnntactttatcataaaaacctctcaaaa

SEQ ID NO: 23 - DNA, 118 bp, Artificial Sequence
  Description of Artificial Sequence: Synthetic polynucleotide
  modified_base (92)..(97): a, c, t, g, unknown or other
ctctccactaccactacgttggaggctcatcgttcctattcccccccccccccccccccccccccccaggcagatgttatcgaggtccgacnnnnnnaaaacaaacttaacctaaaat

SEQ ID NO: 24 - DNA, 118 bp, Artificial Sequence
  Description of Artificial Sequence: Synthetic polynucleotide
  modified_base (96)..(101): a, c, t, g, unknown or other
ccaataaattaaaccaatactaacgttggaggctcatcgttcctattccccccccccccccccccccccccaggcagatgttatcgaggtccgacnnnnnnaccaacacaaaacaaaa

SEQ ID NO: 25 - DNA, 118 bp, Artificial Sequence
  Description of Artificial Sequence: Synthetic polynucleotide
  modified_base (87)..(92): a, c, t, g, unknown or other
acccaaaacttaattctttcttaaagttggaggctcatcgttcctattccccccccccccccaggcagatgttatcgaggtccgacnnnnnntaccaataacccctatttaaactctt

SEQ ID NO: 26 - DNA, 118 bp, Artificial Sequence
  Description of Artificial Sequence: Synthetic polynucleotide
  modified_base (94)..(99): a, c, t, g, unknown or other
aaactcaaaattccaacaacttagttggaggctcatcgttcctattcccccccccccccccccccccccaggcagatgttatcgaggtccgacnnnnnnaaacctttacaaactttct

SEQ ID NO: 27 - DNA, 118 bp, Artificial Sequence
  Description of Artificial Sequence: Synthetic polynucleotide
  modified_base (86)..(91): a, c, t, g, unknown or other
aaactaaaccccctaatattcctttaattcagttggaggctcatcgttcctattcccccccaggcagatgttatcgaggtccgacnnnnnnaaaaattaaaatattataaaacccaaa

SEQ ID NO: 28 - DNA, 118 bp, Artificial Sequence
  Description of Artificial Sequence: Synthetic polynucleotide
  modified_base (93)..(98): a, c, t, g, unknown or other
tcccaacaccttcctcccttcaagttggaggctcatcgttcctattccccccccccccccccccccccaggcagatgttatcgaggtccgacnnnnnnaactcaataaacttattcct

SEQ ID NO: 29 - DNA, 118 bp, Artificial Sequence
  Description of Artificial Sequence: Synthetic polynucleotide
  modified_base (94)..(99): a, c, t, g, unknown or other
ctatacctaaataaccccctagttggaggctcatcgttcctattcccccccccccccccccccccccccaggcagatgttatcgaggtccgacnnnnnnaaaaccatcctctaaccaa

SEQ ID NO: 30 - DNA, 118 bp, Artificial Sequence
  Description of Artificial Sequence: Synthetic polynucleotide
  modified_base (93)..(98): a, c, t, g, unknown or other
ccctacaaaaactacctaaagttggaggctcatcgttcctattcccccccccccccccccccccccccaggcagatgttatcgaggtccgacnnnnnntttacctcttcataaacaaa

SEQ ID NO: 31 - DNA, 118 bp, Artificial Sequence
  Description of Artificial Sequence: Synthetic polynucleotide
  modified_base (87)..(92): a, c, t, g, unknown or other
ccaaaccctcaaacttagttggaggctcatcgttcctattccccccccccccccccccccccaggcagatgttatcgaggtccgacnnnnnntctttttatcttctactaaaaacata

SEQ ID NO: 32 - DNA, 118 bp, Artificial Sequence
  Description of Artificial Sequence: Synthetic polynucleotide
  modified_base (90)..(95): a, c, t, g, unknown or other
ctctaccaacctcccccaaaatctccaaaaatgttggaggctcatcgttcctattccccccccccaggcagatgttatcgaggtccgacnnnnnnattttaatttcaacccatcccca

SEQ ID NO: 33 - DNA, 118 bp, Artificial Sequence
  Description of Artificial Sequence: Synthetic polynucleotide
  modified_base (96)..(101): a, c, t, g, unknown or other
accctactacatatccagttggaggctcatcgttcctattcccccccccccccccccccccccccccccccaggcagatgttatcgaggtccgacnnnnnntttcctaaccccaaaat

SEQ ID NO: 34 - DNA, 118 bp, Artificial Sequence
  Description of Artificial Sequence: Synthetic polynucleotide
  modified_base (93)..(98): a, c, t, g, unknown or other
tactaataaaacttcaaataaacaaagttggaggctcatcgttcctattcccccccccccccccccccaggcagatgttatcgaggtccgacnnnnnncacttaattataaacccctc

SEQ ID NO: 35 - DNA, 118 bp, Artificial Sequence
  Description of Artificial Sequence: Synthetic polynucleotide
  modified_base (97)..(102): a, c, t, g, unknown or other
atctcctataaaccaataaaagttggaggctcatcgttcctattccccccccccccccccccccccccccccaggcagatgttatcgaggtccgacnnnnnntcccacctccaccctt

SEQ ID NO: 36 - DNA, 118 bp, Artificial Sequence
  Description of Artificial Sequence: Synthetic polynucleotide
  modified_base (94)..(99): a, c, t, g, unknown or other
atccttcaacccccaacgttggaggctcatcgttcctattcccccccccccccccccccccccccccccaggcagatgttatcgaggtccgacnnnnnntcacacacttaaaaacaaa

SEQ ID NO: 37 - DNA, 118 bp, Artificial Sequence
  Description of Artificial Sequence: Synthetic polynucleotide
  modified_base (83)..(88): a, c, t, g, unknown or other
acccaactatattcctttaacgttggaggctcatcgttcctattccccccccccccccaggcagatgttatcgaggtccgacnnnnnnttctcaaattaaaatctaaatatttactta

SEQ ID NO: 38 - DNA, 118 bp, Artificial Sequence
  Description of Artificial Sequence: Synthetic polynucleotide
  modified_base (91)..(96): a, c, t, g, unknown or other
ccataaaaactcaatacctgttggaggctcatcgttcctattccccccccccccccccccccccccaggcagatgttatcgaggtccgacnnnnnnaaactaataaacaactaaaact

SEQ ID NO: 39 - DNA, 118 bp, Artificial Sequence
  Description of Artificial Sequence: Synthetic polynucleotide
  modified_base (93)..(98): a, c, t, g, unknown or other
aacccaaacaacctatactgttggaggctcatcgttcctattccccccccccccccccccccccccccaggcagatgttatcgaggtccgacnnnnnnaaaaaccttcctattacact

SEQ ID NO: 40 - DNA, 118 bp, Artificial Sequence
  Description of Artificial Sequence: Synthetic polynucleotide
  modified_base (91)..(96): a, c, t, g, unknown or other
attcccaaccactacaaaatattaccaacctgttggaggctcatcgttcctattccccccccccccaggcagatgttatcgaggtccgacnnnnnnaacctcctaaatataattccct

SEQ ID NO: 41 - DNA, 118 bp, Artificial Sequence
  Description of Artificial Sequence: Synthetic polynucleotide
  modified_base (91)..(96): a, c, t, g, unknown or other
cctaaaaactcctatcccgttggaggctcatcgttcctattcccccccccccccccccccccccccaggcagatgttatcgaggtccgacnnnnnntaaaaacctcttcaaaataatt

SEQ ID NO: 42 - DNA, 118 bp, Artificial Sequence
  Description of Artificial Sequence: Synthetic polynucleotide
  modified_base (94)..(99): a, c, t, g, unknown or other
ctacaaactctaaactactaaacgttggaggctcatcgttcctattcccccccccccccccccccccccaggcagatgttatcgaggtccgacnnnnnnaccacctaataatctacaa

SEQ ID NO: 43 - DNA, 118 bp, Artificial Sequence
  Description of Artificial Sequence: Synthetic polynucleotide
  modified_base (95)..(100): a, c, t, g, unknown or other
cttctcatacaacttccttacagttggaggctcatcgttcctattcccccccccccccccccccccccccaggcagatgttatcgaggtccgacnnnnnntccctcaccctactaact

SEQ ID NO: 44 - DNA, 118 bp, Artificial Sequence
  Description of Artificial Sequence: Synthetic polynucleotide
  modified_base (92)..(97): a, c, t, g, unknown or other
ctatttaactatccctatcatcgttggaggctcatcgttcctattccccccccccccccccccccccaggcagatgttatcgaggtccgacnnnnnnaaaaatcctttcaacaataaa

SEQ ID NO: 45 - DNA, 118 bp, Artificial Sequence
  Description of Artificial Sequence: Synthetic polynucleotide
  modified_base (92)..(97): a, c, t, g, unknown or other
caattcctctccttcaccacgttggaggctcatcgttcctattccccccccccccccccccccccccaggcagatgttatcgaggtccgacnnnnnnaatctaacaccatattcaatt

SEQ ID NO: 46 - DNA, 118 bp, Artificial Sequence
  Description of Artificial Sequence: Synthetic polynucleotide
  modified_base (90)..(95): a, c, t, g, unknown or other
atctttataaaaactccttttaatctcgttggaggctcatcgttcctattcccccccccccccccaggcagatgttatcgaggtccgacnnnnnnctaatctactactcaaaataaaa

SEQ ID NO: 47 - DNA, 118 bp, Artificial Sequence
  Description of Artificial Sequence: Synthetic polynucleotide
  modified_base (87)..(92): a, c, t, g, unknown or other
atccactaccaaacaaacatttcccgttggaggctcatcgttcctattccccccccccccccaggcagatgttatcgaggtccgacnnnnnntacctaaacttaaaataattctccta

SEQ ID NO: 48 - DNA, 118 bp, Artificial Sequence
  Description of Artificial Sequence: Synthetic polynucleotide
  modified_base (88)..(93): a, c, t, g, unknown or other
accaacctatacaatcctctgttggaggctcatcgttcctattccccccccccccccccccccaggcagatgttatcgaggtccgacnnnnnnataaaaccaactatcaatttctaaa

SEQ ID NO: 49 - DNA, 118 bp, Artificial Sequence
  Description of Artificial Sequence: Synthetic polynucleotide
  modified_base (87)..(92): a, c, t, g, unknown or other
acccaacaaacacaaaacaaaaacttcccgttggaggctcatcgttcctattccccccccccaggcagatgttatcgaggtccgacnnnnnntacctaacaccccataaaaataaatt

SEQ ID NO: 50 - DNA, 118 bp, Artificial Sequence
  Description of Artificial Sequence: Synthetic polynucleotide
  modified_base (93)..(98): a, c, t, g, unknown or other
cactttacatttatacttcttaactgttggaggctcatcgttcctattccccccccccccccccccccaggcagatgttatcgaggtccgacnnnnnntcacattaacaaaaatcaaa

SEQ ID NO: 51 - DNA, 118 bp, Artificial Sequence
  Description of Artificial Sequence: Synthetic polynucleotide
  modified_base (91)..(96): a, c, t, g, unknown or other
acctattctataaaactatttcttacagttggaggctcatcgttcctattccccccccccccccccaggcagatgttatcgaggtccgacnnnnnntcccttaatctaataataccaa

SEQ ID NO: 52 - DNA, 118 bp, Artificial Sequence
  Description of Artificial Sequence: Synthetic polynucleotide
  modified_base (94)..(99): a, c, t, g, unknown or other
actcctccaatacctaaattagttggaggctcatcgttcctattcccccccccccccccccccccccccaggcagatgttatcgaggtccgacnnnnnnttaactaacacacaaaact

SEQ ID NO: 53 - DNA, 118 bp, Artificial Sequence
  Description of Artificial Sequence: Synthetic polynucleotide
  modified_base (93)..(98): a, c, t, g, unknown or other
acctaaccctcctctaacgttggaggctcatcgttcctattcccccccccccccccccccccccccccaggcagatgttatcgaggtccgacnnnnnnaaaaatcttaactcacaaac

SEQ ID NO: 54 - DNA, 118 bp, Artificial Sequence
  Description of Artificial Sequence: Synthetic polynucleotide
  modified_base (92)..(97): a, c, t, g, unknown or other
cccaactatattaaaaacaaaagttggaggctcatcgttcctattccccccccccccccccccccccaggcagatgttatcgaggtccgacnnnnnntaactctcctaaaatctaacc

SEQ ID NO: 55 - DNA, 118 bp, Artificial Sequence
  Description of Artificial Sequence: Synthetic polynucleotide
  modified_base (83)..(88): a, c, t, g, unknown or other
atttaatttaatcccttcccaccgttggaggctcatcgttcctattccccccccccccaggcagatgttatcgaggtccgacnnnnnnttttccaattaaaacttccaaaacaattaa

SEQ ID NO: 56 - DNA, 118 bp, Artificial Sequence
  Description of Artificial Sequence: Synthetic polynucleotide
  modified_base (93)..(98): a, c, t, g, unknown or other
atcactaaaaccacttcctgttggaggctcatcgttcctattccccccccccccccccccccccccccaggcagatgttatcgaggtccgacnnnnnnacaaaactaaaccacaaaaa

SEQ ID NO: 57 - DNA, 118 bp, Artificial Sequence
  Description of Artificial Sequence: Synthetic polynucleotide
  modified_base (86)..(91): a, c, t, g, unknown or other
acaatttataaacttataatctatacccttttgttggaggctcatcgttcctattccccccaggcagatgttatcgaggtccgacnnnnnnatattaaaatataaattctttcttttt

SEQ ID NO: 58 - DNA, 118 bp, Artificial Sequence
  Description of Artificial Sequence: Synthetic polynucleotide
  modified_base (87)..(92): a, c, t, g, unknown or other
accatatcctcctacactctaaacaatctcagttggaggctcatcgttcctattccccccccaggcagatgttatcgaggtccgacnnnnnnaaatccctccataaacctccattatt

SEQ ID NO: 59 - DNA, 118 bp, Artificial Sequence
  Description of Artificial Sequence: Synthetic polynucleotide
  modified_base (93)..(98): a, c, t, g, unknown or other
ccaccaatcttctcaacagttggaggctcatcgttcctattcccccccccccccccccccccccccccaggcagatgttatcgaggtccgacnnnnnnaaacctcattccaaaattat

SEQ ID NO: 60 - DNA, 118 bp, Artificial Sequence
  Description of Artificial Sequence: Synthetic polynucleotide
  modified_base (88)..(93): a, c, t, g, unknown or other
aaaaatcaaatccacaaacaccgttggaggctcatcgttcctattccccccccccccccccccaggcagatgttatcgaggtccgacnnnnnnactattttaacctaaaaactaaata

SEQ ID NO: 61 - DNA, 118 bp, Artificial Sequence
  Description of Artificial Sequence: Synthetic polynucleotide
  modified_base (94)..(99): a, c, t, g, unknown or other
acacaacctacaataaccgttggaggctcatcgttcctattccccccccccccccccccccccccccccaggcagatgttatcgaggtccgacnnnnnnctacccacctaataaatca

SEQ ID NO: 62 - DNA, 118 bp, Artificial Sequence
  Description of Artificial Sequence: Synthetic polynucleotide
  modified_base (93)..(98): a, c, t, g, unknown or other
ctaacttaatcctcccttttcgttggaggctcatcgttcctattccccccccccccccccccccccccaggcagatgttatcgaggtccgacnnnnnntctcaaaactttcaactaaa

SEQ ID NO: 63 - DNA, 118 bp, Artificial Sequence
  Description of Artificial Sequence: Synthetic polynucleotide
  modified_base (91)..(96): a, c, t, g, unknown or other
attcaaaaatcttaaaaacaaaatcaatcctgttggaggctcatcgttcctattccccccccccccaggcagatgttatcgaggtccgacnnnnnnataaactttcctaacaaaccta

SEQ ID NO: 64 - DNA, 118 bp, Artificial Sequence
  Description of Artificial Sequence: Synthetic polynucleotide
  modified_base (87)..(92): a, c, t, g, unknown or other
ataccacacaccccacaccagttggaggctcatcgttcctattcccccccccccccccccccaggcagatgttatcgaggtccgacnnnnnnaaataatataactttaccaataaaat

SEQ ID NO: 65 - DNA, 118 bp, Artificial Sequence
  Description of Artificial Sequence: Synthetic polynucleotide
  modified_base (88)..(93): a, c, t, g, unknown or other
attcaaactaacaaatacctatacatacgttggaggctcatcgttcctattccccccccccccaggcagatgttatcgaggtccgacnnnnnntttttaacctctatttatttaaaaa

SEQ ID NO: 66 - DNA, 118 bp, Artificial Sequence
  Description of Artificial Sequence: Synthetic polynucleotide
  modified_base (92)..(97): a, c, t, g, unknown or other
caccaatccctaacataagttggaggctcatcgttcctattccccccccccccccccccccccccccaggcagatgttatcgaggtccgacnnnnnnaactaaactaacaaaaccttt

SEQ ID NO: 67 - DNA, 118 bp, Artificial Sequence
  Description of Artificial Sequence: Synthetic polynucleotide
  modified_base (87)..(92): a, c, t, g, unknown or other
ataaaaacatataaccccacaaaaccgttggaggctcatcgttcctattcccccccccccccaggcagatgttatcgaggtccgacnnnnnnttaaaataaaacatataataaaacct

SEQ ID NO: 68 - DNA, 118 bp, Artificial Sequence
  Description of Artificial Sequence: Synthetic polynucleotide
  modified_base (91)..(96): a, c, t, g, unknown or other
acaccctccaaaaaccccaatccacagttggaggctcatcgttcctattcccccccccccccccccaggcagatgttatcgaggtccgacnnnnnnaaccttattacaaaaatacatt

SEQ ID NO: 69 - DNA, 118 bp, Artificial Sequence
  Description of Artificial Sequence: Synthetic polynucleotide
  modified_base (95)..(100): a, c, t, g, unknown or other
caccttataactatttcctaaacactgttggaggctcatcgttcctattcccccccccccccccccccccaggcagatgttatcgaggtccgacnnnnnnaaactaccacacctactt

SEQ ID NO: 70 - DNA, 118 bp, Artificial Sequence
  Description of Artificial Sequence: Synthetic polynucleotide
  modified_base (95)..(100): a, c, t, g, unknown or other
acacaaactaaaccccaagttggaggctcatcgttcctattcccccccccccccccccccccccccccccaggcagatgttatcgaggtccgacnnnnnnaaaaacacaattcaacac

SEQ ID NO: 71 - DNA, 118 bp, Artificial Sequence
  Description of Artificial Sequence: Synthetic polynucleotide
  modified_base (92)..(97): a, c, t, g, unknown or other
cctaaatcaaaactactaaaaagttggaggctcatcgttcctattccccccccccccccccccccccaggcagatgttatcgaggtccgacnnnnnnacttatttctacataaaacca

SEQ ID NO: 72 - DNA, 118 bp, Artificial Sequence
  Description of Artificial Sequence: Synthetic polynucleotide
  modified_base (91)..(96): a, c, t, g, unknown or other
taattcctaaaaaccaacacgttggaggctcatcgttcctattcccccccccccccccccccccccaggcagatgttatcgaggtccgacnnnnnnaaaataaaactaccttaatcca

SEQ ID NO: 73 - DNA, 118 bp, Artificial Sequence
  Description of Artificial Sequence: Synthetic polynucleotide
  modified_base (92)..(97): a, c, t, g, unknown or other
cacaataatttatatttctccagttggaggctcatcgttcctattccccccccccccccccccccccaggcagatgttatcgaggtccgacnnnnnntaaaaccatcacttctaactc

SEQ ID NO: 74 - DNA, 118 bp, Artificial Sequence
  Description of Artificial Sequence: Synthetic polynucleotide
  modified_base (92)..(97): a, c, t, g, unknown or other
aaacaaactacacttctcgttggaggctcatcgttcctattccccccccccccccccccccccccccaggcagatgttatcgaggtccgacnnnnnntactacactcttctaaaacta

SEQ ID NO: 75 - DNA, 118 bp, Artificial Sequence
  Description of Artificial Sequence: Synthetic polynucleotide
  modified_base (84)..(89): a, c, t, g, unknown or other
acaaataaaactaccccctcaaaaaccccgttggaggctcatcgttcctattcccccccaggcagatgttatcgaggtccgacnnnnnnaaaaccaatcacctataacctataaccat

SEQ ID NO: 76 - DNA, 118 bp, Artificial Sequence
  Description of Artificial Sequence: Synthetic polynucleotide
  modified_base (90)..(95): a, c, t, g, unknown or other
attccaacaccctcccgttggaggctcatcgttcctattccccccccccccccccccccccccccaggcagatgttatcgaggtccgacnnnnnnaaaaactactaatcaaaacactt

SEQ ID NO: 77 - DNA, 118 bp, Artificial Sequence
  Description of Artificial Sequence: Synthetic polynucleotide
  modified_base (92)..(97): a, c, t, g, unknown or other
cctacattatcctaataacccgttggaggctcatcgttcctattcccccccccccccccccccccccaggcagatgttatcgaggtccgacnnnnnntaactatacctaaacccaaaa

SEQ ID NO: 78 - DNA, 118 bp, Artificial Sequence
  Description of Artificial Sequence: Synthetic polynucleotide
  modified_base (94)..(99): a, c, t, g, unknown or other
caactacctaaatcaaactttcgttggaggctcatcgttcctattccccccccccccccccccccccccaggcagatgttatcgaggtccgacnnnnnnaataccaattaaccaactt

SEQ ID NO: 79 - DNA, 118 bp, Artificial Sequence
  Description of Artificial Sequence: Synthetic polynucleotide
  modified_base (92)..(97): a, c, t, g, unknown or other
ctccataacccaaacaaatgttggaggctcatcgttcctattcccccccccccccccccccccccccaggcagatgttatcgaggtccgacnnnnnntcctcaatttcactaaaatta

SEQ ID NO: 80 - DNA, 118 bp, Artificial Sequence
  Description of Artificial Sequence: Synthetic polynucleotide
  modified_base (91)..(96): a, c, t, g, unknown or other
acttcactacatccaacagttggaggctcatcgttcctattcccccccccccccccccccccccccaggcagatgttatcgaggtccgacnnnnnnttccttacataaatctcaaaaa

SEQ ID NO: 81 - DNA, 118 bp, Artificial Sequence
  Description of Artificial Sequence: Synthetic polynucleotide
  modified_base (97)..(102): a, c, t, g, unknown or other
aaacacaaaccaaactccttacacccactaccgttggaggctcatcgttcctattcccccccccccccccccaggcagatgttatcgaggtccgacnnnnnnactaccacaaaaccac

SEQ ID NO: 82 - DNA, 118 bp, Artificial Sequence
  Description of Artificial Sequence: Synthetic polynucleotide
  modified_base (91)..(96): a, c, t, g, unknown or other
aaaacatctcaaaaacaacgttggaggctcatcgttcctattccccccccccccccccccccccccaggcagatgttatcgaggtccgacnnnnnnaaaaataattcttcacaaccct

SEQ ID NO: 83 - DNA, 118 bp, Artificial Sequence
  Description of Artificial Sequence: Synthetic polynucleotide
  modified_base (89)..(94): a, c, t, g, unknown or other
acattctcccaaattcctcccctctacccgttggaggctcatcgttcctattccccccccccccaggcagatgttatcgaggtccgacnnnnnnaaattcatatcttattctaatcat

SEQ ID NO: 84 - DNA, 118 bp, Artificial Sequence
  Description of Artificial Sequence: Synthetic polynucleotide
  modified_base (93)..(98): a, c, t, g, unknown or other
actcctaccactctctccacaactaacagttggaggctcatcgttcctattcccccccccccccccccaggcagatgttatcgaggtccgacnnnnnnatattttaattccaccacat

SEQ ID NO: 85 - DNA, 118 bp, Artificial Sequence
  Description of Artificial Sequence: Synthetic polynucleotide
  modified_base (86)..(91): a, c, t, g, unknown or other
taatatttttcctcataaattaaattaacgttggaggctcatcgttcctattcccccccccaggcagatgttatcgaggtccgacnnnnnnaacctccctaaactacttaccctaccc

SEQ ID NO: 86 - DNA, 118 bp, Artificial Sequence
  Description of Artificial Sequence: Synthetic polynucleotide
  modified_base (96)..(101): a, c, t, g, unknown or other
ctcaaaacaaacctctaaaaaccctgttggaggctcatcgttcctattcccccccccccccccccccccccaggcagatgttatcgaggtccgacnnnnnnaacctccaaaatcaaca

SEQ ID NO: 87 - DNA, 118 bp, Artificial Sequence
  Description of Artificial Sequence: Synthetic polynucleotide
  modified_base (83)..(88): a, c, t, g, unknown or other
acccatcaacctcattaaacataactttcgttggaggctcatcgttcctattccccccaggcagatgttatcgaggtccgacnnnnnntccccttctacccttacactctttactaaa

SEQ ID NO: 88 - DNA, 118 bp, Artificial Sequence
  Description of Artificial Sequence: Synthetic polynucleotide
  modified_base (89)..(94): a, c, t, g, unknown or other
aaaacctcaaacccccaagttggaggctcatcgttcctattcccccccccccccccccccccccaggcagatgttatcgaggtccgacnnnnnnttaatttatcaccaaatttaaaaa

SEQ ID NO: 89 - DNA, 118 bp, Artificial Sequence
  Description of Artificial Sequence: Synthetic polynucleotide
  modified_base (97)..(102): a, c, t, g, unknown or other
tattaaaacctttaataaaaacactctaaacagttggaggctcatcgttcctattcccccccccccccccccaggcagatgttatcgaggtccgacnnnnnncaacttctcctacccc

SEQ ID NO: 90 - DNA, 118 bp, Artificial Sequence
  Description of Artificial Sequence: Synthetic polynucleotide
  modified_base (92)..(97): a, c, t, g, unknown or other
aaatactcatctcctacaaagttggaggctcatcgttcctattccccccccccccccccccccccccaggcagatgttatcgaggtccgacnnnnnnaaactttaaactacaaaaact

SEQ ID NO: 91 - DNA, 118 bp, Artificial Sequence
  Description of Artificial Sequence: Synthetic polynucleotide
  modified_base (87)..(92): a, c, t, g, unknown or other
ttataaccttttctcctacagttggaggctcatcgttcctattcccccccccccccccccccaggcagatgttatcgaggtccgacnnnnnnttataaatctaaccttatattcacac

SEQ ID NO: 92 - DNA, 118 bp, Artificial Sequence
  Description of Artificial Sequence: Synthetic polynucleotide
  modified_base (92)..(97): a, c, t, g, unknown or other
aaaccactacaaataaaataaagttggaggctcatcgttcctattccccccccccccccccccccccaggcagatgttatcgaggtccgacnnnnnntttaaaacaactaccataaca

SEQ ID NO: 93 - DNA, 118 bp, Artificial Sequence
  Description of Artificial Sequence: Synthetic polynucleotide
  modified_base (89)..(94): a, c, t, g, unknown or other
tcaaccctactatctatacaactccgttggaggctcatcgttcctattccccccccccccccccaggcagatgttatcgaggtccgacnnnnnnttcttaatacttaaaactaaaaac

SEQ ID NO: 94 - DNA, 118 bp, Artificial Sequence
  Description of Artificial Sequence: Synthetic polynucleotide
  modified_base (86)..(91): a, c, t, g, unknown or other
acatcaccaacccacaaccagttggaggctcatcgttcctattccccccccccccccccccaggcagatgttatcgaggtccgacnnnnnnaatatcaaaaatctaaacccaacataa

SEQ ID NO: 95 - DNA, 118 bp, Artificial Sequence
  Description of Artificial Sequence: Synthetic polynucleotide
  modified_base (95)..(100): a, c, t, g, unknown or other
attccccaaactacctgttggaggctcatcgttcctattcccccccccccccccccccccccccccccccaggcagatgttatcgaggtccgacnnnnnntacaatcaaacaccaaaa

SEQ ID NO: 96 - DNA, 118 bp, Artificial Sequence
  Description of Artificial Sequence: Synthetic polynucleotide
  modified_base (91)..(96): a, c, t, g, unknown or other
actcaaataccaaatcccgttggaggctcatcgttcctattcccccccccccccccccccccccccaggcagatgttatcgaggtccgacnnnnnnaaaaccaaataacaaatctaaa

SEQ ID NO: 97 - DNA, 118 bp, Artificial Sequence
  Description of Artificial Sequence: Synthetic polynucleotide
  modified_base (89)..(94): a, c, t, g, unknown or other
aaaaactcccctacctatgttggaggctcatcgttcctattcccccccccccccccccccccccaggcagatgttatcgaggtccgacnnnnnnacatctaaaacaaaaacataaaaa

SEQ ID NO: 98 - DNA, 118 bp, Artificial Sequence
  Description of Artificial Sequence: Synthetic polynucleotide
  modified_base (95)..(100): a, c, t, g, unknown or other
ccaaaaatctccattcatgttggaggctcatcgttcctattcccccccccccccccccccccccccccccaggcagatgttatcgaggtccgacnnnnnnaaacaataattcaacccc

SEQ ID NO: 99 - DNA, 118 bp, Artificial Sequence
  Description of Artificial Sequence: Synthetic polynucleotide
  modified_base (94)..(99): a, c, t, g, unknown or other
aatacaaaccccctacccgttggaggctcatcgttcctattccccccccccccccccccccccccccccaggcagatgttatcgaggtccgacnnnnnncaattcaaacttaaaccca

SEQ ID NO: 100 - DNA, 118 bp, Artificial Sequence
  Description of Artificial Sequence: Synthetic polynucleotide
  modified_base (93)..(98): a, c, t, g, unknown or other
aatcaaaatcccaaatacacagttggaggctcatcgttcctattccccccccccccccccccccccccaggcagatgttatcgaggtccgacnnnnnnttccacatctaccaaataaa

SEQ ID NO: 101 - DNA, 118 bp, Artificial Sequence
  Description of Artificial Sequence: Synthetic polynucleotide
  modified_base (89)..(94): a, c, t, g, unknown or other
ctcatctcacaactcattgttggaggctcatcgttcctattcccccccccccccccccccccccaggcagatgttatcgaggtccgacnnnnnnaaacctaaataaacacatatacat

SEQ ID NO: 102 - DNA, 118 bp, Artificial Sequence
  Description of Artificial Sequence: Synthetic polynucleotide
  modified_base (84)..(89): a, c, t, g, unknown or other
atttctacacaatcacaacccaatgttggaggctcatcgttcctattccccccccccccaggcagatgttatcgaggtccgacnnnnnnttaccaacaaatcttatcatattcctctt

SEQ ID NO: 103 - DNA, 118 bp, Artificial Sequence
  Description of Artificial Sequence: Synthetic polynucleotide
  modified_base (90)..(95): a, c, t, g, unknown or other
atcctaaaaatataaaaataacaacttaaaaagttggaggctcatcgttcctattccccccccccaggcagatgttatcgaggtccgacnnnnnnaaatctcctatttctcttcctaa

SEQ ID NO: 104 - DNA, 118 bp, Artificial Sequence
  Description of Artificial Sequence: Synthetic polynucleotide
  modified_base (93)..(98): a, c, t, g, unknown or other
aaacaaatctcttaaaataaaaactgttggaggctcatcgttcctattccccccccccccccccccccaggcagatgttatcgaggtccgacnnnnnntatactctcaatccctccca

SEQ ID NO: 105 - DNA, 118 bp, Artificial Sequence
  Description of Artificial Sequence: Synthetic polynucleotide
  modified_base (90)..(95): a, c, t, g, unknown or other
ctcccaccaaccaatcgttggaggctcatcgttcctattccccccccccccccccccccccccccaggcagatgttatcgaggtccgacnnnnnntttcctctcattctaaataaaaa

SEQ ID NO: 106 - DNA, 118 bp, Artificial Sequence
  Description of Artificial Sequence: Synthetic polynucleotide
  modified_base (93)..(98): a, c, t, g, unknown or other
ctctaacacacctaaaaatttcgttggaggctcatcgttcctattcccccccccccccccccccccccaggcagatgttatcgaggtccgacnnnnnnaaaatacaaccaaataaacc

SEQ ID NO: 107 - DNA, 118 bp, Artificial Sequence
  Description of Artificial Sequence: Synthetic polynucleotide
  modified_base (87)..(92): a, c, t, g, unknown or other
atccccaacaatctataaaccacaactttcgttggaggctcatcgttcctattcccccccccaggcagatgttatcgaggtccgacnnnnnnaatttcttactctcattaaaaataat

SEQ ID NO: 108 - DNA, 118 bp, Artificial Sequence
  Description of Artificial Sequence: Synthetic polynucleotide
  modified_base (87)..(92): a, c, t, g, unknown or other
acaaacaactcacctaagttggaggctcatcgttcctattccccccccccccccccccccccaggcagatgttatcgaggtccgacnnnnnnaaattaaaacaattcacaaaacattt

SEQ ID NO: 109 - DNA, 118 bp, Artificial Sequence
  Description of Artificial Sequence: Synthetic polynucleotide
  modified_base (97)..(102): a, c, t, g, unknown or other
actaaacccctccccagttggaggctcatcgttcctattcccccccccccccccccccccccccccccccccaggcagatgttatcgaggtccgacnnnnnnacttcaactcctccat

SEQ ID NO: 110 - DNA, 118 bp, Artificial Sequence
  Description of Artificial Sequence: Synthetic polynucleotide
  modified_base (88)..(93): a, c, t, g, unknown or other
atccctcctttatatacacaccacccaacctagttggaggctcatcgttcctattccccccccaggcagatgttatcgaggtccgacnnnnnntatttcaaaaacaaatactccccta

SEQ ID NO: 111 - DNA, 118 bp, Artificial Sequence
  Description of Artificial Sequence: Synthetic polynucleotide
  modified_base (88)..(93): a, c, t, g, unknown or other
acccaacccaaactacaatcataacaaaagttggaggctcatcgttcctattcccccccccccaggcagatgttatcgaggtccgacnnnnnntaactaacccaaaacactaatccct

SEQ ID NO: 112 - DNA, 118 bp, Artificial Sequence
  Description of Artificial Sequence: Synthetic polynucleotide
  modified_base (85)..(90): a, c, t, g, unknown or other
acttaaacttatttcctaattcaaccctgttggaggctcatcgttcctattcccccccccaggcagatgttatcgaggtccgacnnnnnntcctattaatcaaatattaataaaaatt

SEQ ID NO: 113 - DNA, 118 bp, Artificial Sequence
  Description of Artificial Sequence: Synthetic polynucleotide
  modified_base (96)..(101): a, c, t, g, unknown or other
accccaaaacaattctacaagttggaggctcatcgttcctattccccccccccccccccccccccccccccaggcagatgttatcgaggtccgacnnnnnnccctaacaaaaacccca

SEQ ID NO: 114 - DNA, 118 bp, Artificial Sequence
  Description of Artificial Sequence: Synthetic polynucleotide
  modified_base (89)..(94): a, c, t, g, unknown or other
ttttaccacttaatcccaacgttggaggctcatcgttcctattcccccccccccccccccccccaggcagatgttatcgaggtccgacnnnnnncctaaacttccttcctctataacc

SEQ ID NO: 115 - DNA, 118 bp, Artificial Sequence
  Description of Artificial Sequence: Synthetic polynucleotide
  modified_base (93)..(98): a, c, t, g, unknown or other
aaaattaaacacattttccccgttggaggctcatcgttcctattccccccccccccccccccccccccaggcagatgttatcgaggtccgacnnnnnnaacctaatacattacaaaca

SEQ ID NO: 116 - DNA, 118 bp, Artificial Sequence
  Description of Artificial Sequence: Synthetic polynucleotide
  modified_base (91)..(96): a, c, t, g, unknown or other
catcccataaaacaaatctcacgttggaggctcatcgttcctattcccccccccccccccccccccaggcagatgttatcgaggtccgacnnnnnntctctttctaaaacaatttaaa

SEQ ID NO: 117 - DNA, 118 bp, Artificial Sequence
  Description of Artificial Sequence: Synthetic polynucleotide
  modified_base (84)..(89): a, c, t, g, unknown or other
atctatactttcattactaataccaccctaccgttggaggctcatcgttcctattccccaggcagatgttatcgaggtccgacnnnnnnacttaaacaaatctatacatctccctaaa

SEQ ID NO: 118 - DNA, 118 bp, Artificial Sequence
  Description of Artificial Sequence: Synthetic polynucleotide
  modified_base (93)..(98): a, c, t, g, unknown or other
attcctacaaaccttactagttggaggctcatcgttcctattccccccccccccccccccccccccccaggcagatgttatcgaggtccgacnnnnnnaaaaacaaaacactaacaaa

SEQ ID NO: 119 - DNA, 118 bp, Artificial Sequence
  Description of Artificial Sequence: Synthetic polynucleotide
  modified_base (93)..(98): a, c, t, g, unknown or other
aacaaaatataaacacatcctgttggaggctcatcgttcctattccccccccccccccccccccccccaggcagatgttatcgaggtccgacnnnnnncaactaaactaaacaaaaca

SEQ ID NO: 120 - DNA, 118 bp, Artificial Sequence
  Description of Artificial Sequence: Synthetic polynucleotide
  modified_base (96)..(101): a, c, t, g, unknown or other
aaataaaacaaatcactctcaaaaagttggaggctcatcgttcctattcccccccccccccccccccccccaggcagatgttatcgaggtccgacnnnnnntttttccctccaaactt

SEQ ID NO: 121 - DNA, 118 bp, Artificial Sequence
  Description of Artificial Sequence: Synthetic polynucleotide
  modified_base (83)..(88): a, c, t, g, unknown or other
ataccccaaaccttattttccctcaaaacgttggaggctcatcgttcctattccccccaggcagatgttatcgaggtccgacnnnnnntataaaaatacaatttcctcactttaaaaa

SEQ ID NO: 122 - DNA, 118 bp, Artificial Sequence
  Description of Artificial Sequence: Synthetic polynucleotide
  modified_base (87)..(92): a, c, t, g, unknown or other
cccccaaaccaaaatagttggaggctcatcgttcctattcccccccccccccccccccccccaggcagatgttatcgaggtccgacnnnnnntaattcttctaattattttacttctt

SEQ ID NO: 123 - DNA, 118 bp, Artificial Sequence
  Description of Artificial Sequence: Synthetic polynucleotide
  modified_base (88)..(93): a, c, t, g, unknown or other
ctaaaaactccttacaacagttggaggctcatcgttcctattcccccccccccccccccccccaggcagatgttatcgaggtccgacnnnnnnaacaacaacctaatatccttcacat

SEQ ID NO: 124 - DNA, 118 bp, Artificial Sequence
  Description of Artificial Sequence: Synthetic polynucleotide
  modified_base (96)..(101): a, c, t, g, unknown or other
actacctctaccataaaaccgttggaggctcatcgttcctattccccccccccccccccccccccccccccaggcagatgttatcgaggtccgacnnnnnntctataccccaatccca

SEQ ID NO: 125 - DNA, 118 bp, Artificial Sequence
  Description of Artificial Sequence: Synthetic polynucleotide
  modified_base (85)..(90): a, c, t, g, unknown or other
atacatcctaaaatactacccaccctaagttggaggctcatcgttcctattcccccccccaggcagatgttatcgaggtccgacnnnnnnttttcttttactaattaaaaataaaaat

SEQ ID NO: 126 - DNA, 118 bp, Artificial Sequence
  Description of Artificial Sequence: Synthetic polynucleotide
  modified_base (92)..(97): a, c, t, g, unknown or other
acttcactcaaataacaaccagttggaggctcatcgttcctattcccccccccccccccccccccccaggcagatgttatcgaggtccgacnnnnnnatacacacctattacaacaaa

SEQ ID NO: 127 - DNA, 118 bp, Artificial Sequence
  Description of Artificial Sequence: Synthetic polynucleotide
  modified_base (92)..(97): a, c, t, g, unknown or other
atctatactaactaataaaaatctcacgttggaggctcatcgttcctattcccccccccccccccccaggcagatgttatcgaggtccgacnnnnnnaaaacattatttccccaaaaa

SEQ ID NO: 128 - DNA, 118 bp, Artificial Sequence
  Description of Artificial Sequence: Synthetic polynucleotide
  modified_base (92)..(97): a, c, t, g, unknown or other
ataaacaaaaccacaacctaaagttggaggctcatcgttcctattccccccccccccccccccccccaggcagatgttatcgaggtccgacnnnnnnactttaaaaccaaacctaaaa

SEQ ID NO: 129 - DNA, 118 bp, Artificial Sequence
  Description of Artificial Sequence: Synthetic polynucleotide
  modified_base (91)..(96): a, c, t, g, unknown or other
tcctcctccaactattactatgttggaggctcatcgttcctattccccccccccccccccccccccaggcagatgttatcgaggtccgacnnnnnntaaataatctacaccaaactac

SEQ ID NO: 130 - DNA, 118 bp, Artificial Sequence
  Description of Artificial Sequence: Synthetic polynucleotide
  modified_base (87)..(92): a, c, t, g, unknown or other
accctaccctccaatacaaaaacttaaccccgttggaggctcatcgttcctattccccccccaggcagatgttatcgaggtccgacnnnnnnacctcctctttcctatcatactaaaa

SEQ ID NO: 131 - DNA, 118 bp, Artificial Sequence
  Description of Artificial Sequence: Synthetic polynucleotide
  modified_base (94)..(99): a, c, t, g, unknown or other
acttaatctacaacaaaaatcaatgttggaggctcatcgttcctattccccccccccccccccccccccaggcagatgttatcgaggtccgacnnnnnntttaacattccacactaaa

SEQ ID NO: 132 - DNA, 118 bp, Artificial Sequence
  Description of Artificial Sequence: Synthetic polynucleotide
  modified_base (86)..(91): a, c, t, g, unknown or other
acccccttcccaacacctcccgttggaggctcatcgttcctattcccccccccccccccccaggcagatgttatcgaggtccgacnnnnnnataaaaacaatactatcaaaacttaat

SEQ ID NO: 133 - DNA, 118 bp, Artificial Sequence
  Description of Artificial Sequence: Synthetic polynucleotide
  modified_base (91)..(96): a, c, t, g, unknown or other
atccacccctctctaagttggaggctcatcgttcctattcccccccccccccccccccccccccccaggcagatgttatcgaggtccgacnnnnnnaatttaacatctctactaacat

SEQ ID NO: 134 - DNA, 118 bp, Artificial Sequence
  Description of Artificial Sequence: Synthetic polynucleotide
  modified_base (94)..(99): a, c, t, g, unknown or other
ccctataactaaaacctaacgttggaggctcatcgttcctattccccccccccccccccccccccccccaggcagatgttatcgaggtccgacnnnnnnacctaatcccaaactactt

SEQ ID NO: 135 - DNA, 118 bp, Artificial Sequence
  Description of Artificial Sequence: Synthetic polynucleotide
  modified_base (90)..(95): a, c, t, g, unknown or other
acacaaacctctcatcaacaataacttaacacgttggaggctcatcgttcctattccccccccccaggcagatgttatcgaggtccgacnnnnnntcccaaatattttcaataatact

SEQ ID NO: 136 - DNA, 118 bp, Artificial Sequence
  Description of Artificial Sequence: Synthetic polynucleotide
  modified_base (90)..(95): a, c, t, g, unknown or other
accaaccccaataacctagttggaggctcatcgttcctattccccccccccccccccccccccccaggcagatgttatcgaggtccgacnnnnnnacaacaaactttttaaaataaaa

SEQ ID NO: 137 - DNA, 118 bp, Artificial Sequence
  Description of Artificial Sequence: Synthetic polynucleotide
  modified_base (95)..(100): a, c, t, g, unknown or other
ccaccaataaaataaaattaaaacgttggaggctcatcgttcctattcccccccccccccccccccccccaggcagatgttatcgaggtccgacnnnnnnaacatcttcctttcacct

SEQ ID NO: 138 - DNA, 118 bp, Artificial Sequence
  Description of Artificial Sequence: Synthetic polynucleotide
  modified_base (93)..(98): a, c, t, g, unknown or other
ccctacaacaaaaatacaagttggaggctcatcgttcctattccccccccccccccccccccccccccaggcagatgttatcgaggtccgacnnnnnnaaaaaccaaaacctcaaaaa

SEQ ID NO: 139 - DNA, 118 bp, Artificial Sequence
  Description of Artificial Sequence: Synthetic polynucleotide
  modified_base (97)..(102): a, c, t, g, unknown or other
actcctaaaaacaaacccgttggaggctcatcgttcctattcccccccccccccccccccccccccccccccaggcagatgttatcgaggtccgacnnnnnncaccaattcaacaacc

SEQ ID NO: 140 - DNA, 118 bp, Artificial Sequence
  Description of Artificial Sequence: Synthetic polynucleotide
  modified_base (86)..(91): a, c, t, g, unknown or other
tctccaacaactaacaaatatcccccgttggaggctcatcgttcctattccccccccccccaggcagatgttatcgaggtccgacnnnnnnttccccacccaaaacaataatcttatt

SEQ ID NO: 141 - DNA, 118 bp, Artificial Sequence
  Description of Artificial Sequence: Synthetic polynucleotide
  modified_base (88)..(93): a, c, t, g, unknown or other
tcctaactctttcaatccctgttggaggctcatcgttcctattccccccccccccccccccccaggcagatgttatcgaggtccgacnnnnnnacaaattactctaactaatttattt

SEQ ID NO: 142 - DNA, 118 bp, Artificial Sequence
  Description of Artificial Sequence: Synthetic polynucleotide
  modified_base (89)..(94): a, c, t, g, unknown or other
acctactatacccaaaataatattttaccccagttggaggctcatcgttcctattcccccccccaggcagatgttatcgaggtccgacnnnnnnaaaataaataacccctaattctca

SEQ ID NO: 143 - DNA, 118 bp, Artificial Sequence
  Description of Artificial Sequence: Synthetic polynucleotide
  modified_base (95)..(100): a, c, t, g, unknown or other
cttcctaaaaataccacccgttggaggctcatcgttcctattccccccccccccccccccccccccccccaggcagatgttatcgaggtccgacnnnnnncaatttttcccaaaacct

SEQ ID NO: 144 - DNA, 118 bp, Artificial Sequence
  Description of Artificial Sequence: Synthetic polynucleotide
  modified_base (88)..(93): a, c, t, g, unknown or other
atcaaactcaccctactgttggaggctcatcgttcctattcccccccccccccccccccccccaggcagatgttatcgaggtccgacnnnnnnaaactacattaaatacatacaaatt

SEQ ID NO: 145 - DNA, 118 bp, Artificial Sequence
  Description of Artificial Sequence: Synthetic polynucleotide
  modified_base (95)..(100): a, c, t, g, unknown or other
ccataaataaaaacctctaaaaagttggaggctcatcgttcctattccccccccccccccccccccccccaggcagatgttatcgaggtccgacnnnnnnactccaatcctcattcaa

SEQ ID NO: 146 - DNA, 118 bp, Artificial Sequence
  Description of Artificial Sequence: Synthetic polynucleotide
  modified_base (95)..(100): a, c, t, g, unknown or other
acctaaccctcctctaacagttggaggctcatcgttcctattccccccccccccccccccccccccccccaggcagatgttatcgaggtccgacnnnnnntcttaactcacaaacacc

SEQ ID NO: 147 - DNA, 118 bp, Artificial Sequence
  Description of Artificial Sequence: Synthetic polynucleotide
  modified_base (85)..(90): a, c, t, g, unknown or other
atccaataaccttataaaacaaacccaaagttggaggctcatcgttcctattccccccccaggcagatgttatcgaggtccgacnnnnnnatttccttttataattttaaatcttaat

SEQ ID NO: 148 - DNA, 118 bp, Artificial Sequence
  Description of Artificial Sequence: Synthetic polynucleotide
  modified_base (97)..(102): a, c, t, g, unknown or other
acccccaacacactcctgttggaggctcatcgttcctattccccccccccccccccccccccccccccccccaggcagatgttatcgaggtccgacnnnnnnaaaatactctccccca

SEQ ID NO: 149 - DNA, 118 bp, Artificial Sequence
  Description of Artificial Sequence: Synthetic polynucleotide
  modified_base (94)..(99): a, c, t, g, unknown or other
tacctattaattttcctttacccacaatgttggaggctcatcgttcctattccccccccccccccccccaggcagatgttatcgaggtccgacnnnnnnaaacaacctttaacctaaa

SEQ ID NO: 150 - DNA, 118 bp, Artificial Sequence
  Description of Artificial Sequence: Synthetic polynucleotide
  modified_base (90)..(95): a, c, t, g, unknown or other
cccctaaaattttctatttcttccccgttggaggctcatcgttcctattccccccccccccccccaggcagatgttatcgaggtccgacnnnnnntctttacactaaacatataaaaa

SEQ ID NO: 151 - DNA, 118 bp, Artificial Sequence
  Description of Artificial Sequence: Synthetic polynucleotide
  modified_base (91)..(96): a, c, t, g, unknown or other
taattccttatatactaaacacttccgttggaggctcatcgttcctattcccccccccccccccccaggcagatgttatcgaggtccgacnnnnnnaccaccttttactactcaactc

SEQ ID NO: 152 - DNA, 118 bp, Artificial Sequence
  Description of Artificial Sequence: Synthetic polynucleotide
  modified_base (89)..(94): a, c, t, g, unknown or other
tcccaaatttaccctctcaagttggaggctcatcgttcctattcccccccccccccccccccccaggcagatgttatcgaggtccgacnnnnnnaattctaaatacttcctaacaatt

SEQ ID NO: 153 - DNA, 118 bp, Artificial Sequence
  Description of Artificial Sequence: Synthetic polynucleotide
  modified_base (91)..(96): a, c, t, g, unknown or other
cttcactaaaattccctctgttggaggctcatcgttcctattccccccccccccccccccccccccaggcagatgttatcgaggtccgacnnnnnntttacaacttttcaccaataac

SEQ ID NO: 154 - DNA, 118 bp, Artificial Sequence
  Description of Artificial Sequence: Synthetic polynucleotide
  modified_base (93)..(98): a, c, t, g, unknown or other
tctcctcatcaaaccaactctctaacttgttggaggctcatcgttcctattcccccccccccccccccaggcagatgttatcgaggtccgacnnnnnnaaaaccaaaaccaactacca

SEQ ID NO: 155 - DNA, 118 bp, Artificial Sequence
  Description of Artificial Sequence: Synthetic polynucleotide
  modified_base (94)..(99): a, c, t, g, unknown or other
acctaccacctcctcagttggaggctcatcgttcctattccccccccccccccccccccccccccccccaggcagatgttatcgaggtccgacnnnnnntcataaaaacctctcaaaa

SEQ ID NO: 156 - DNA, 118 bp, Artificial Sequence
  Description of Artificial Sequence: Synthetic polynucleotide
  modified_base (91)..(96): a, c, t, g, unknown or other
atccctaccctcctacaaaacacacttcgttggaggctcatcgttcctattcccccccccccccccaggcagatgttatcgaggtccgacnnnnnnaccatttaacaacattttataa

SEQ ID NO: 157 - DNA, 118 bp, Artificial Sequence
  Description of Artificial Sequence: Synthetic polynucleotide
  modified_base (85)..(90): a, c, t, g, unknown or other
actacaaaactctaaaaataaaccaaaacccgttggaggctcatcgttcctattccccccaggcagatgttatcgaggtccgacnnnnnntcatcataatacaattttaataataaca

SEQ ID NO: 158 - DNA, 118 bp, Artificial Sequence
  Description of Artificial Sequence: Synthetic polynucleotide
  modified_base (91)..(96): a, c, t, g, unknown or other
tcctatctcaaatctatttccttgttggaggctcatcgttcctattccccccccccccccccccccaggcagatgttatcgaggtccgacnnnnnnttaacctcctaaattcttctaa

SEQ ID NO: 159 - DNA, 118 bp, Artificial Sequence
  Description of Artificial Sequence: Synthetic polynucleotide
  modified_base (88)..(93): a, c, t, g, unknown or other
attctaactccaaaacccacactgttggaggctcatcgttcctattcccccccccccccccccaggcagatgttatcgaggtccgacnnnnnnctctcaatattaattataattcatt

SEQ ID NO: 160 - DNA, 118 bp, Artificial Sequence
  Description of Artificial Sequence: Synthetic polynucleotide
  modified_base (93)..(98): a, c, t, g, unknown or other
acccacaaaaccaccagttggaggctcatcgttcctattcccccccccccccccccccccccccccccaggcagatgttatcgaggtccgacnnnnnntctaaaaatcctaaccctaa

SEQ ID NO: 161 - DNA, 118 bp, Artificial Sequence
  Description of Artificial Sequence: Synthetic polynucleotide
  modified_base (88)..(93): a, c, t, g, unknown or other
atacaaaactataaataaccattacatatcccgttggaggctcatcgttcctattccccccccaggcagatgttatcgaggtccgacnnnnnntaatcctaaaattaaaccatacctt

SEQ ID NO: 162 - DNA, 118 bp, Artificial Sequence
  Description of Artificial Sequence: Synthetic polynucleotide
  modified_base (89)..(94): a, c, t, g, unknown or other
ataccaaattccataccaaaccccgttggaggctcatcgttcctattcccccccccccccccccaggcagatgttatcgaggtccgacnnnnnntcactaacttctcataaataccta

SEQ ID NO: 163 - DNA, 118 bp, Artificial Sequence
  Description of Artificial Sequence: Synthetic polynucleotide
  modified_base (94)..(99): a, c, t, g, unknown or other
tccaccccacaccttaaacctcataatattaagttggaggctcatcgttcctattccccccccccccccaggcagatgttatcgaggtccgacnnnnnnacaataacaaacctacaaa

SEQ ID NO: 164 - DNA, 118 bp, Artificial Sequence
  Description of Artificial Sequence: Synthetic polynucleotide
  modified_base (91)..(96): a, c, t, g, unknown or other
accctaccaatactaactctaaataaacccgttggaggctcatcgttcctattcccccccccccccaggcagatgttatcgaggtccgacnnnnnnattccaaaccctactctattat

SEQ ID NO: 165 - DNA, 118 bp, Artificial Sequence
  Description of Artificial Sequence: Synthetic polynucleotide
  modified_base (90)..(95): a, c, t, g, unknown or other
ctatatcaccctttcctaccgttggaggctcatcgttcctattccccccccccccccccccccccaggcagatgttatcgaggtccgacnnnnnnttctctttcccacaaataccaaa

SEQ ID NO: 166 - DNA, 118 bp, Artificial Sequence
  Description of Artificial Sequence: Synthetic polynucleotide
  modified_base (93)..(98): a, c, t, g, unknown or other
aatccaaaatcttaccattacgttggaggctcatcgttcctattccccccccccccccccccccccccaggcagatgttatcgaggtccgacnnnnnnaattccaaaaacaacttttt

SEQ ID NO: 167 - DNA, 118 bp, Artificial Sequence
  Description of Artificial Sequence: Synthetic polynucleotide
  modified_base (89)..(94): a, c, t, g, unknown or other
accaactatctcaattcaccgttggaggctcatcgttcctattcccccccccccccccccccccaggcagatgttatcgaggtccgacnnnnnnaattatacccaactaaattaaatt

SEQ ID NO: 168 - DNA, 118 bp, Artificial Sequence
  Description of Artificial Sequence: Synthetic polynucleotide
  modified_base (92)..(97): a, c, t, g, unknown or other
cattaaaatcctaaactcactgttggaggctcatcgttcctattcccccccccccccccccccccccaggcagatgttatcgaggtccgacnnnnnnaaacaacctaaactacaaaaa

SEQ ID NO: 169 - DNA, 118 bp, Artificial Sequence
  Description of Artificial Sequence: Synthetic polynucleotide
  modified_base (92)..(97): a, c, t, g, unknown or other
acacccaacaaaacaaagttggaggctcatcgttcctattcccccccccccccccccccccccccccaggcagatgttatcgaggtccgacnnnnnnaaaacacaaaactaactttaa

SEQ ID NO: 170 - DNA, 118 bp, Artificial Sequence
  Description of Artificial Sequence: Synthetic polynucleotide
  modified_base (82)..(87): a, c, t, g, unknown or other
actccaaaacaactatcaaacgttggaggctcatcgttcctattcccccccccccccaggcagatgttatcgaggtccgacnnnnnntttataatcttcaactttactcactataatt

SEQ ID NO: 171 - DNA, 118 bp, Artificial Sequence
  Description of Artificial Sequence: Synthetic polynucleotide
  modified_base (91)..(96): a, c, t, g, unknown or other
tcaaaaccctaatccaaaacccgttggaggctcatcgttcctattcccccccccccccccccccccaggcagatgttatcgaggtccgacnnnnnntcctaaatataacctaaaatct

SEQ ID NO: 172 - DNA, 118 bp, Artificial Sequence
  Description of Artificial Sequence: Synthetic polynucleotide
  modified_base (90)..(95): a, c, t, g, unknown or other
ccttcttaactactcacctaatgttggaggctcatcgttcctattccccccccccccccccccccaggcagatgttatcgaggtccgacnnnnnntttttcttcacaaattttacaca

SEQ ID NO: 173 - DNA, 118 bp, Artificial Sequence
  Description of Artificial Sequence: Synthetic polynucleotide
  modified_base (85)..(90): a, c, t, g, unknown or other
caacatcttaaaaacttccgttggaggctcatcgttcctattccccccccccccccccccaggcagatgttatcgaggtccgacnnnnnntcacctctctcctcaacctccaaaactt

SEQ ID NO: 174 - DNA, 118 bp, Artificial Sequence
  Description of Artificial Sequence: Synthetic polynucleotide
  modified_base (89)..(94): a, c, t, g, unknown or other
ccacaattatacaaacaacagttggaggctcatcgttcctattcccccccccccccccccccccaggcagatgttatcgaggtccgacnnnnnnaaaacttattttacaattaaatct

SEQ ID NO: 175 - DNA, 118 bp, Artificial Sequence
  Description of Artificial Sequence: Synthetic polynucleotide
  modified_base (91)..(96): a, c, t, g, unknown or other
cttccctatactaacaccgttggaggctcatcgttcctattcccccccccccccccccccccccccaggcagatgttatcgaggtccgacnnnnnncctctctaaactataaaaattt

SEQ ID NO: 176 - DNA, 118 bp, Artificial Sequence
  Description of Artificial Sequence: Synthetic polynucleotide
  modified_base (89)..(94): a, c, t, g, unknown or other
aaactctatccctttaacacaaacgttggaggctcatcgttcctattcccccccccccccccccaggcagatgttatcgaggtccgacnnnnnnaacaaattattacttttccttact

SEQ ID NO: 177 - DNA, 118 bp, Artificial Sequence
  Description of Artificial Sequence: Synthetic polynucleotide
  modified_base (96)..(101): a, c, t, g, unknown or other
ctcatccaaaacctcataaaactattgttggaggctcatcgttcctattccccccccccccccccccccccaggcagatgttatcgaggtccgacnnnnnnacactcaacaactacaa

SEQ ID NO: 178 - DNA, 118 bp, Artificial Sequence
  Description of Artificial Sequence: Synthetic polynucleotide
  modified_base (90)..(95): a, c, t, g, unknown or other
acccatttcctactctccaaaattaaccactgttggaggctcatcgttcctattcccccccccccaggcagatgttatcgaggtccgacnnnnnntaccctaccaaatttaccaaaat

SEQ ID NO: 179 - DNA, 118 bp, Artificial Sequence
  Description of Artificial Sequence: Synthetic polynucleotide
  modified_base (92)..(97): a, c, t, g, unknown or other
ctcccaccaaccaatcgttggaggctcatcgttcctattccccccccccccccccccccccccccccaggcagatgttatcgaggtccgacnnnnnntttcctctcattctaaataaa

SEQ ID NO: 180 - DNA, 118 bp, Artificial Sequence
  Description of Artificial Sequence: Synthetic polynucleotide
  modified_base (97)..(102): a, c, t, g, unknown or other
attaactaatccacctaccgttggaggctcatcgttcctattccccccccccccccccccccccccccccccaggcagatgttatcgaggtccgacnnnnnncaaccttacttctccc

SEQ ID NO: 181 - DNA, 118 bp, Artificial Sequence
  Description of Artificial Sequence: Synthetic polynucleotide
  modified_base (93)..(98): a, c, t, g, unknown or other
ataactaacctaaaacttccgttggaggctcatcgttcctattcccccccccccccccccccccccccaggcagatgttatcgaggtccgacnnnnnnaataaaaacaacacctacta

SEQ ID NO: 182 - DNA, 118 bp, Artificial Sequence
  Description of Artificial Sequence: Synthetic polynucleotide
  modified_base (88)..(93): a, c, t, g, unknown or other
ccacacaaaatacactacgttggaggctcatcgttcctattccccccccccccccccccccccaggcagatgttatcgaggtccgacnnnnnnaaaactccttaatataattttaaaa

SEQ ID NO: 183 - DNA, 118 bp, Artificial Sequence
  Description of Artificial Sequence: Synthetic polynucleotide
  modified_base (93)..(98): a, c, t, g, unknown or other
cttcaacaacttaaaacacgttggaggctcatcgttcctattccccccccccccccccccccccccccaggcagatgttatcgaggtccgacnnnnnnaacacaatatccactaaaaa

SEQ ID NO: 184 - DNA, 118 bp, Artificial Sequence
  Description of Artificial Sequence: Synthetic polynucleotide
  modified_base (92)..(97): a, c, t, g, unknown or other
ttcctactacaataataaactacctccgttggaggctcatcgttcctattcccccccccccccccccaggcagatgttatcgaggtccgacnnnnnntttcaattttcctttctactt

SEQ ID NO: 185 - DNA, 118 bp, Artificial Sequence
  Description of Artificial Sequence: Synthetic polynucleotide
  modified_base (97)..(102): a, c, t, g, unknown or other
accataaaactaacacccgttggaggctcatcgttcctattcccccccccccccccccccccccccccccccaggcagatgttatcgaggtccgacnnnnnnctcctcccaaccccca

SEQ ID NO: 186 - DNA, 118 bp, Artificial Sequence
  Description of Artificial Sequence: Synthetic polynucleotide
  modified_base (91)..(96): a, c, t, g, unknown or other
aaccaacaatctccccgttggaggctcatcgttcctattcccccccccccccccccccccccccccaggcagatgttatcgaggtccgacnnnnnnaacacctaacaaataataaaat

SEQ ID NO: 187 - DNA, 118 bp, Artificial Sequence
  Description of Artificial Sequence: Synthetic polynucleotide
  modified_base (94)..(99): a, c, t, g, unknown or other
aaacactataccactccaaagttggaggctcatcgttcctattccccccccccccccccccccccccccaggcagatgttatcgaggtccgacnnnnnntcccaactcaaaataaaaa

SEQ ID NO: 188 - DNA, 118 bp, Artificial Sequence
  Description of Artificial Sequence: Synthetic polynucleotide
  modified_base (87)..(92): a, c, t, g, unknown or other
atttttataactaaaactaatttctaaccgttggaggctcatcgttcctattccccccccccaggcagatgttatcgaggtccgacnnnnnnttataaaacaaccaacaactttctct

SEQ ID NO: 189 - DNA, 118 bp, Artificial Sequence
  Description of Artificial Sequence: Synthetic polynucleotide
  modified_base (93)..(98): a, c, t, g, unknown or other
ccaaatctacctacttaaatacgttggaggctcatcgttcctattcccccccccccccccccccccccaggcagatgttatcgaggtccgacnnnnnnaccaatcctaactcaactca

SEQ ID NO: 190 - DNA, 118 bp, Artificial Sequence
  Description of Artificial Sequence: Synthetic polynucleotide
  modified_base (92)..(97): a, c, t, g, unknown or other
atccaacctaccaaacagttggaggctcatcgttcctattcccccccccccccccccccccccccccaggcagatgttatcgaggtccgacnnnnnntaactaacaacattaactcta

SEQ ID NO: 191 - DNA, 118 bp, Artificial Sequence
  Description of Artificial Sequence: Synthetic polynucleotide
  modified_base (95)..(100): a, c, t, g, unknown or other
acaaaaacatccccctgttggaggctcatcgttcctattcccccccccccccccccccccccccccccccaggcagatgttatcgaggtccgacnnnnnncccaaacaccaatccccc

SEQ ID NO: 192 - DNA, 118 bp, Artificial Sequence
  Description of Artificial Sequence: Synthetic polynucleotide
  modified_base (91)..(96): a, c, t, g, unknown or other
ctaaaccctattacccccgttggaggctcatcgttcctattcccccccccccccccccccccccccaggcagatgttatcgaggtccgacnnnnnnaaaataaattttccttaaccaa

SEQ ID NO: 193 - DNA, 118 bp, Artificial Sequence
  Description of Artificial Sequence: Synthetic polynucleotide
  modified_base (89)..(94): a, c, t, g, unknown or other
ctaaatctataatacaaaaacccgttggaggctcatcgttcctattccccccccccccccccccaggcagatgttatcgaggtccgacnnnnnncaaaaataaactaaacaataaaaa

SEQ ID NO: 194 - DNA, 118 bp, Artificial Sequence
  Description of Artificial Sequence: Synthetic polynucleotide
  modified_base (91)..(96): a, c, t, g, unknown or other
cccactattttctcttcctacgttggaggctcatcgttcctattccccccccccccccccccccccaggcagatgttatcgaggtccgacnnnnnntaactcaacaatcttaactttt

SEQ ID NO: 195 - DNA, 118 bp, Artificial Sequence
  Description of Artificial Sequence: Synthetic polynucleotide
  modified_base (87)..(92): a, c, t, g, unknown or other
atactttctttaaatatatacctaaataaacgttggaggctcatcgttcctattccccccccaggcagatgttatcgaggtccgacnnnnnnaaaaactctttaaataaaactaaata

SEQ ID NO: 196 - DNA, 118 bp, Artificial Sequence
  Description of Artificial Sequence: Synthetic polynucleotide
  modified_base (97)..(102): a, c, t, g, unknown or other
aaaacccctcctttcctgttggaggctcatcgttcctattccccccccccccccccccccccccccccccccaggcagatgttatcgaggtccgacnnnnnncttccccaacctccac

SEQ ID NO: 197 - DNA, 118 bp, Artificial Sequence
  Description of Artificial Sequence: Synthetic polynucleotide
  modified_base (93)..(98): a, c, t, g, unknown or other
aatttatctttcactaaaaccgttggaggctcatcgttcctattccccccccccccccccccccccccaggcagatgttatcgaggtccgacnnnnnnctttccttcatcttaactat

SEQ ID NO: 198 - DNA, 118 bp, Artificial Sequence
  Description of Artificial Sequence: Synthetic polynucleotide
  modified_base (91)..(96): a, c, t, g, unknown or other
ccaaacaaaaaccccaacaagttggaggctcatcgttcctattcccccccccccccccccccccccaggcagatgttatcgaggtccgacnnnnnnaccataacctttttaaataaaa

SEQ ID NO: 199 - DNA, 118 bp, Artificial Sequence
  Description of Artificial Sequence: Synthetic polynucleotide
  modified_base (92)..(97): a, c, t, g, unknown or other
ccccatcctttcctacctaagttggaggctcatcgttcctattccccccccccccccccccccccccaggcagatgttatcgaggtccgacnnnnnntccacacactaaccctaaaaa

SEQ ID NO: 200 - DNA, 118 bp, Artificial Sequence
  Description of Artificial Sequence: Synthetic polynucleotide
  modified_base (92)..(97): a, c, t, g, unknown or other
acactaactttcaaatacatatgttggaggctcatcgttcctattccccccccccccccccccccccaggcagatgttatcgaggtccgacnnnnnntatccaaaatacaaacaattt

SEQ ID NO: 201 - DNA, 118 bp, Artificial Sequence
  Description of Artificial Sequence: Synthetic polynucleotide
  modified_base (91)..(96): a, c, t, g, unknown or other
atcctaataacttcctcttcagttggaggctcatcgttcctattccccccccccccccccccccccaggcagatgttatcgaggtccgacnnnnnntacttcctaccccctaaaacta

SEQ ID NO: 202 - DNA, 118 bp, Artificial Sequence
  Description of Artificial Sequence: Synthetic polynucleotide
  modified_base (92)..(97): a, c, t, g, unknown or other
ttttaataatacctccttataacaagttggaggctcatcgttcctattcccccccccccccccccccaggcagatgttatcgaggtccgacnnnnnnaacaaacactaaatttaaaca

SEQ ID NO: 203 - DNA, 118 bp, Artificial Sequence
  Description of Artificial Sequence: Synthetic polynucleotide
  modified_base (88)..(93): a, c, t, g, unknown or other
attcaaaataacctattaacaacaatcaagttggaggctcatcgttcctattcccccccccccaggcagatgttatcgaggtccgacnnnnnnttttcccattaattaaaatcaccaa

SEQ ID NO: 204 - DNA, 118 bp, Artificial Sequence
  Description of Artificial Sequence: Synthetic polynucleotide
  modified_base (90)..(95): a, c, t, g, unknown or other
acttatctaaaatcacacaagttggaggctcatcgttcctattccccccccccccccccccccccaggcagatgttatcgaggtccgacnnnnnnaaacaaaaacttacataaatctt

SEQ ID NO: 205 - DNA, 118 bp, Artificial Sequence
  Description of Artificial Sequence: Synthetic polynucleotide
  modified_base (92)..(97): a, c, t, g, unknown or other
ttacaaacaaaccacacctactattgttggaggctcatcgttcctattcccccccccccccccccccaggcagatgttatcgaggtccgacnnnnnnaaaaattaaaacctcaaactt

SEQ ID NO: 206 - DNA, 118 bp, Artificial Sequence
  Description of Artificial Sequence: Synthetic polynucleotide
  modified_base (90)..(95): a, c, t, g, unknown or other
cttctacaaaaccccctgttggaggctcatcgttcctattcccccccccccccccccccccccccaggcagatgttatcgaggtccgacnnnnnnttaaccctactaactaaaaactt

SEQ ID NO: 207 - DNA, 118 bp, Artificial Sequence
  Description of Artificial Sequence: Synthetic polynucleotide
  modified_base (90)..(95): a, c, t, g, unknown or other
aaaccacaaacttcctgttggaggctcatcgttcctattccccccccccccccccccccccccccaggcagatgttatcgaggtccgacnnnnnntctacttaaatattcaaacaaat

SEQ ID NO: 208 - DNA, 118 bp, Artificial Sequence
  Description of Artificial Sequence: Synthetic polynucleotide
  modified_base (81)..(86): a, c, t, g, unknown or other
acctttattcctccccaacaaaaccgttggaggctcatcgttcctattccccccccaggcagatgttatcgaggtccgacnnnnnnatattaccctctaaactaaaaaccaaaaccct

SEQ ID NO: 209 - DNA, 118 bp, Artificial Sequence
  Description of Artificial Sequence: Synthetic polynucleotide
  modified_base (93)..(98): a, c, t, g, unknown or other
acccaaactcctacaaagttggaggctcatcgttcctattccccccccccccccccccccccccccccaggcagatgttatcgaggtccgacnnnnnnaaaactcacctacttaaaaa

SEQ ID NO: 210 - DNA, 118 bp, Artificial Sequence
  Description of Artificial Sequence: Synthetic polynucleotide
  modified_base (90)..(95): a, c, t, g, unknown or other
cctaaaaaccaaacaaaccagttggaggctcatcgttcctattccccccccccccccccccccccaggcagatgttatcgaggtccgacnnnnnnaaaaattttcaattaactacatt

SEQ ID NO: 211 - DNA, 118 bp, Artificial Sequence
  Description of Artificial Sequence: Synthetic polynucleotide
  modified_base (91)..(96): a, c, t, g, unknown or other
atcacaaacccctctcgttggaggctcatcgttcctattcccccccccccccccccccccccccccaggcagatgttatcgaggtccgacnnnnnnacccacatatacaaaataacaa

SEQ ID NO: 212 - DNA, 118 bp, Artificial Sequence
  Description of Artificial Sequence: Synthetic polynucleotide
  modified_base (94)..(99): a, c, t, g, unknown or other
taaaacttatataactactatatctaaaaagttggaggctcatcgttcctattccccccccccccccccaggcagatgttatcgaggtccgacnnnnnncctacaaaaactactaacc

SEQ ID NO: 213 - DNA, 118 bp, Artificial Sequence
  Description of Artificial Sequence: Synthetic polynucleotide
  modified_base (90)..(95): a, c, t, g, unknown or other
caaacactaataccaccaaaagttggaggctcatcgttcctattcccccccccccccccccccccaggcagatgttatcgaggtccgacnnnnnnaaactcaaaattaaaaattactt

SEQ ID NO: 214 - DNA, 118 bp, Artificial Sequence
  Description of Artificial Sequence: Synthetic polynucleotide
  modified_base (91)..(96): a, c, t, g, unknown or other
atttttcaaaacctcattttaaccgttggaggctcatcgttcctattcccccccccccccccccccaggcagatgttatcgaggtccgacnnnnnnaaaaactaacaaaaaccctaaa

SEQ ID NO: 215 - DNA, 118 bp, Artificial Sequence
  Description of Artificial Sequence: Synthetic polynucleotide
  modified_base (93)..(98): a, c, t, g, unknown or other
ctacaaaaacctaaatcacaagttggaggctcatcgttcctattccccccccccccccccccccccccaggcagatgttatcgaggtccgacnnnnnnaaactaaactcaacccataa

SEQ ID NO: 216 - DNA, 118 bp, Artificial Sequence
  Description of Artificial Sequence: Synthetic polynucleotide
  modified_base (82)..(87): a, c, t, g, unknown or other
tccactaaccaaattccgttggaggctcatcgttcctattcccccccccccccccccaggcagatgttatcgaggtccgacnnnnnnaatttttcccaacatcccccaaaccacttct

SEQ ID NO: 217 - DNA, 118 bp, Artificial Sequence
  Description of Artificial Sequence: Synthetic polynucleotide
  modified_base (92)..(97): a, c, t, g, unknown or other
ttttaatcaaactactcctaacccgttggaggctcatcgttcctattccccccccccccccccccccaggcagatgttatcgaggtccgacnnnnnntaaactaaactcctacaaaaa

SEQ ID NO: 218 - DNA, 118 bp, Artificial Sequence
  Description of Artificial Sequence: Synthetic polynucleotide
  modified_base (86)..(91): a, c, t, g, unknown or other
tcctcactccttttattcttttagttggaggctcatcgttcctattcccccccccccccccaggcagatgttatcgaggtccgacnnnnnntaaatatttacccattaatacctttta

SEQ ID NO: 219 - DNA, 118 bp, Artificial Sequence
  Description of Artificial Sequence: Synthetic polynucleotide
  modified_base (93)..(98): a, c, t, g, unknown or other
caaacatcaaaactctcctatagttggaggctcatcgttcctattcccccccccccccccccccccccaggcagatgttatcgaggtccgacnnnnnnacaacatccttttaaactaa

SEQ ID NO: 220 - DNA, 118 bp, Artificial Sequence
  Description of Artificial Sequence: Synthetic polynucleotide
  modified_base (88)..(93): a, c, t, g, unknown or other
cctaaataaccattcctcagttggaggctcatcgttcctattcccccccccccccccccccccaggcagatgttatcgaggtccgacnnnnnntactataaacccaaaatatttataa

SEQ ID NO: 221 - DNA, 118 bp, Artificial Sequence
  Description of Artificial Sequence: Synthetic polynucleotide
  modified_base (91)..(96): a, c, t, g, unknown or other
acttccccacactcatgttggaggctcatcgttcctattcccccccccccccccccccccccccccaggcagatgttatcgaggtccgacnnnnnnaaataaaaacaacaaaattcaa

SEQ ID NO: 222 - DNA, 118 bp, Artificial Sequence
  Description of Artificial Sequence: Synthetic polynucleotide
  modified_base (93)..(98): a, c, t, g, unknown or other
aatttaaaatccaaactacaccaccacccttgttggaggctcatcgttcctattccccccccccccccaggcagatgttatcgaggtccgacnnnnnntccaaatcttccactaaacc

SEQ ID NO: 223 - DNA, 118 bp, Artificial Sequence
  Description of Artificial Sequence: Synthetic polynucleotide
  modified_base (87)..(92): a, c, t, g, unknown or other
atttcccctaaacataaacatttaaactacctgttggaggctcatcgttcctattcccccccaggcagatgttatcgaggtccgacnnnnnnttctttttccctaacataaaattcat

SEQ ID NO: 224 - DNA, 118 bp, Artificial Sequence
  Description of Artificial Sequence: Synthetic polynucleotide
  modified_base (89)..(94): a, c, t, g, unknown or other
acccacaatttccaaactatcaccaaacgttggaggctcatcgttcctattcccccccccccccaggcagatgttatcgaggtccgacnnnnnnaatttaatctataccttatatccc

SEQ ID NO: 225 - DNA, 118 bp, Artificial Sequence
  Description of Artificial Sequence: Synthetic polynucleotide
  modified_base (92)..(97): a, c, t, g, unknown or other
ctcaaaacttttcacaccaaagttggaggctcatcgttcctattcccccccccccccccccccccccaggcagatgttatcgaggtccgacnnnnnnaactcacattaaaaattctca

SEQ ID NO: 226 - DNA, 118 bp, Artificial Sequence
  Description of Artificial Sequence: Synthetic polynucleotide
  modified_base (91)..(96): a, c, t, g, unknown or other
caatcctctcaaacttaatctctacgttggaggctcatcgttcctattccccccccccccccccccaggcagatgttatcgaggtccgacnnnnnnactcactaaaactaatctaaaa

SEQ ID NO: 227 - DNA, 118 bp, Artificial Sequence
  Description of Artificial Sequence: Synthetic polynucleotide
  modified_base (83)..(88): a, c, t, g, unknown or other
atttacccacacttcctaactccaaactttgttggaggctcatcgttcctattcccccaggcagatgttatcgaggtccgacnnnnnnttttaccctatattcctattccccttcctt

SEQ ID NO: 228 - DNA, 118 bp, Artificial Sequence
  Description of Artificial Sequence: Synthetic polynucleotide
  modified_base (90)..(95): a, c, t, g, unknown or other
ttccaaaattacacaacacttgttggaggctcatcgttcctattcccccccccccccccccccccaggcagatgttatcgaggtccgacnnnnnnttaaaacccttcttaaaaataat

SEQ ID NO: 229 - DNA, 118 bp, Artificial Sequence
  Description of Artificial Sequence: Synthetic polynucleotide
  modified_base (89)..(94): a, c, t, g, unknown or other
acaccctccaaacctacacctcttaatccagttggaggctcatcgttcctattcccccccccccaggcagatgttatcgaggtccgacnnnnnnaattaaaacacaattacccaacaa

SEQ ID NO: 230 - DNA, 118 bp, Artificial Sequence
  Description of Artificial Sequence: Synthetic polynucleotide
  modified_base (96)..(101): a, c, t, g, unknown or other
ctaacttttcttccaaccgttggaggctcatcgttcctattccccccccccccccccccccccccccccccaggcagatgttatcgaggtccgacnnnnnnttcctcccctaccctaa

SEQ ID NO: 231 - DNA, 118 bp, Artificial Sequence
  Description of Artificial Sequence: Synthetic polynucleotide
  modified_base (83)..(88): a, c, t, g, unknown or other
acaaaccctactaaataatatttcccgttggaggctcatcgttcctattcccccccccaggcagatgttatcgaggtccgacnnnnnnaaaaataattaaaacctactattctctttt

SEQ ID NO: 232 - DNA, 118 bp, Artificial Sequence
  Description of Artificial Sequence: Synthetic polynucleotide
  modified_base (93)..(98): a, c, t, g, unknown or other
cttactccctcattcccgttggaggctcatcgttcctattccccccccccccccccccccccccccccaggcagatgttatcgaggtccgacnnnnnnaaaaatcccaatttctaaca

SEQ ID NO: 233 - DNA, 118 bp, Artificial Sequence
  Description of Artificial Sequence: Synthetic polynucleotide
  modified_base (88)..(93): a, c, t, g, unknown or other
tcctctaactacccttaaaccctgttggaggctcatcgttcctattcccccccccccccccccaggcagatgttatcgaggtccgacnnnnnnaaataaaatccacctattccttttt

SEQ ID NO: 234 - DNA, 118 bp, Artificial Sequence
  Description of Artificial Sequence: Synthetic polynucleotide
  modified_base (87)..(92): a, c, t, g, unknown or other
attcccttataacaaactaactcccaacgttggaggctcatcgttcctattcccccccccccaggcagatgttatcgaggtccgacnnnnnnttttaaaataatatttctaaccatct

SEQ ID NO: 235 - DNA, 118 bp, Artificial Sequence
  Description of Artificial Sequence: Synthetic polynucleotide
  modified_base (94)..(99): a, c, t, g, unknown or other
aattttctcaactcaaaactccgttggaggctcatcgttcctattccccccccccccccccccccccccaggcagatgttatcgaggtccgacnnnnnnaaaaccataaactctcaaa

SEQ ID NO: 236 - DNA, 118 bp, Artificial Sequence
  Description of Artificial Sequence: Synthetic polynucleotide
  modified_base (93)..(98): a, c, t, g, unknown or other
ctatctccaaactcaactgttggaggctcatcgttcctattcccccccccccccccccccccccccccaggcagatgttatcgaggtccgacnnnnnnattcatatatttacacccac

SEQ ID NO: 237 - DNA, 118 bp, Artificial Sequence
  Description of Artificial Sequence: Synthetic polynucleotide
  modified_base (93)..(98): a, c, t, g, unknown or other
cactatataactaaaactactaacgttggaggctcatcgttcctattcccccccccccccccccccccaggcagatgttatcgaggtccgacnnnnnnttcctactttccccaaaaca

SEQ ID NO: 238 - DNA, 118 bp, Artificial Sequence
  Description of Artificial Sequence: Synthetic polynucleotide
  modified_base (89)..(94): a, c, t, g, unknown or other
atcctaaaatcaaaacaaaaagttggaggctcatcgttcctattccccccccccccccccccccaggcagatgttatcgaggtccgacnnnnnnaaaataaatttccttcataaaaat

SEQ ID NO: 239 - DNA, 118 bp, Artificial Sequence
  Description of Artificial Sequence: Synthetic polynucleotide
  modified_base (87)..(92): a, c, t, g, unknown or other
acacttcctctttcctctaaacagttggaggctcatcgttcctattccccccccccccccccaggcagatgttatcgaggtccgacnnnnnnttactatcattattttccacaaatat

SEQ ID NO: 240 - DNA, 118 bp, Artificial Sequence
  Description of Artificial Sequence: Synthetic polynucleotide
  modified_base (83)..(88): a, c, t, g, unknown or other
ataaaaactaaaataaatattaaataaaaagttggaggctcatcgttcctattcccccaggcagatgttatcgaggtccgacnnnnnntcctaaacttttccaaaaatctccattcat

SEQ ID NO: 241 - DNA, 118 bp, Artificial Sequence
  Description of Artificial Sequence: Synthetic polynucleotide
  modified_base (96)..(101): a, c, t, g, unknown or other
ataattaaccctaaaataccccgttggaggctcatcgttcctattccccccccccccccccccccccccccaggcagatgttatcgaggtccgacnnnnnncaccaaaaactcactca

SEQ ID NO: 242 - DNA, 118 bp, Artificial Sequence
  Description of Artificial Sequence: Synthetic polynucleotide
  modified_base (88)..(93): a, c, t, g, unknown or other
acccttttctcccctcccttttctccgttggaggctcatcgttcctattccccccccccccccaggcagatgttatcgaggtccgacnnnnnnacataaacttaacttaacctaaaaa

SEQ ID NO: 243 - DNA, 118 bp, Artificial Sequence
  Description of Artificial Sequence: Synthetic polynucleotide
  modified_base (87)..(92): a, c, t, g, unknown or other
acccctttttaatccccaaaataaacccttctgttggaggctcatcgttcctattcccccccaggcagatgttatcgaggtccgacnnnnnnatactacttaaaatactatctaaaaa

SEQ ID NO: 244 - DNA, 118 bp, Artificial Sequence
  Description of Artificial Sequence: Synthetic polynucleotide
  modified_base (90)..(95): a, c, t, g, unknown or other
atctccaaacttacaacacttcccaaagttggaggctcatcgttcctattcccccccccccccccaggcagatgttatcgaggtccgacnnnnnnaaatcttcctacaaaataccccc

SEQ ID NO: 245 - DNA, 118 bp, Artificial Sequence
  Description of Artificial Sequence: Synthetic polynucleotide
  modified_base (95)..(100): a, c, t, g, unknown or other
actacaacaccaaatctccccaacaaccagttggaggctcatcgttcctattccccccccccccccccccaggcagatgttatcgaggtccgacnnnnnnaaccaacctcaccaacaa

SEQ ID NO: 246 - DNA, 118 bp, Artificial Sequence
  Description of Artificial Sequence: Synthetic polynucleotide
  modified_base (93)..(98): a, c, t, g, unknown or other
acccaccaccaaacttcatcccaaccgttggaggctcatcgttcctattcccccccccccccccccccaggcagatgttatcgaggtccgacnnnnnnaatctcattcctaataatcc

SEQ ID NO: 247 - DNA, 118 bp, Artificial Sequence
  Description of Artificial Sequence: Synthetic polynucleotide
  modified_base (88)..(93): a, c, t, g, unknown or other
ataatcccaactactcaaaaagttggaggctcatcgttcctattcccccccccccccccccccaggcagatgttatcgaggtccgacnnnnnntttttaaaacatatttaaccaacct

SEQ ID NO: 248 - DNA, 118 bp, Artificial Sequence
  Description of Artificial Sequence: Synthetic polynucleotide
  modified_base (90)..(95): a, c, t, g, unknown or other
acaactatacaatactccaacgttggaggctcatcgttcctattcccccccccccccccccccccaggcagatgttatcgaggtccgacnnnnnnaaaattcactccctaactaaaaa

SEQ ID NO: 249 - DNA, 118 bp, Artificial Sequence
  Description of Artificial Sequence: Synthetic polynucleotide
  modified_base (84)..(89): a, c, t, g, unknown or other
acttaataaattcctactctaaccagttggaggctcatcgttcctattcccccccccccaggcagatgttatcgaggtccgacnnnnnnttttcattaattttcctaacaattctttt

SEQ ID NO: 250 - DNA, 118 bp, Artificial Sequence
  Description of Artificial Sequence: Synthetic polynucleotide
  modified_base (87)..(92): a, c, t, g, unknown or other
cccaccaacacctaaacaacatgttggaggctcatcgttcctattcccccccccccccccccaggcagatgttatcgaggtccgacnnnnnnaaatctacctcaatcacttaaaaatc

SEQ ID NO: 251 - DNA, 118 bp, Artificial Sequence
  Description of Artificial Sequence: Synthetic polynucleotide
  modified_base (91)..(96): a, c, t, g, unknown or other
cctatcctaaccaactcaatgttggaggctcatcgttcctattcccccccccccccccccccccccaggcagatgttatcgaggtccgacnnnnnntcaaaataactttatcaaaaac

SEQ ID NO: 252 - DNA, 118 bp, Artificial Sequence
  Description of Artificial Sequence: Synthetic polynucleotide
  modified_base (88)..(93): a, c, t, g, unknown or other
actccaacaataaaaccaattaaactgttggaggctcatcgttcctattccccccccccccccaggcagatgttatcgaggtccgacnnnnnnactaaaaacttccctaccttaaatt

SEQ ID NO: 253 - DNA, 118 bp, Artificial Sequence; identical to SEQ ID NO: 71
  Description of Artificial Sequence: Synthetic polynucleotide
  modified_base (92)..(97): a, c, t, g, unknown or other

SEQ ID NO: 254 - DNA, 118 bp, Artificial Sequence
  Description of Artificial Sequence: Synthetic polynucleotide
  modified_base (93)..(98): a, c, t, g, unknown or other
ctttactatttattcctactcaagttggaggctcatcgttcctattccccccccccccccccccccccaggcagatgttatcgaggtccgacnnnnnnttcaaccttatcacttaaca

SEQ ID NO: 255 - DNA, 118 bp, Artificial Sequence
  Description of Artificial Sequence: Synthetic polynucleotide
  modified_base (93)..(98): a, c, t, g, unknown or other
aaaaacaccacctataaaaagttggaggctcatcgttcctattcccccccccccccccccccccccccaggcagatgttatcgaggtccgacnnnnnnttctccaactccttatcaaa

SEQ ID NO: 256 - DNA, 118 bp, Artificial Sequence
  Description of Artificial Sequence: Synthetic polynucleotide
  modified_base (93)..(98): a, c, t, g, unknown or other
aaaaaccacaaacctacgttggaggctcatcgttcctattccccccccccccccccccccccccccccaggcagatgttatcgaggtccgacnnnnnntaaaatactaacaacctcaa

SEQ ID NO: 257 - DNA, 118 bp, Artificial Sequence
  Description of Artificial Sequence: Synthetic polynucleotide
  modified_base (87)..(92): a, c, t, g, unknown or other
acaaataaatataataactttatttaaagttggaggctcatcgttcctattcccccccccccaggcagatgttatcgaggtccgacnnnnnnttaaatttaccaaaatctataaataa

SEQ ID NO: 258 - DNA, 118 bp, Artificial Sequence
  Description of Artificial Sequence: Synthetic polynucleotide
  modified_base (90)..(95): a, c, t, g, unknown or other
ctctaccaaacccctccgttggaggctcatcgttcctattcccccccccccccccccccccccccaggcagatgttatcgaggtccgacnnnnnnaaaccctaaacaacttttcccaa

SEQ ID NO: 259 - DNA, 118 bp, Artificial Sequence
  Description of Artificial Sequence: Synthetic polynucleotide
  modified_base (94)..(99): a, c, t, g, unknown or other
acttctacttatttaacacttaaaaagttggaggctcatcgttcctattccccccccccccccccccccaggcagatgttatcgaggtccgacnnnnnntttccttattaaccaacaa

SEQ ID NO: 260 - DNA, 118 bp, Artificial Sequence
  Description of Artificial Sequence: Synthetic polynucleotide
  modified_base (90)..(95): a, c, t, g, unknown or other
ccttttcacaccaaaaagttggaggctcatcgttcctattcccccccccccccccccccccccccaggcagatgttatcgaggtccgacnnnnnnaaaccattctatcttccaaataa

SEQ ID NO: 261 - DNA, 118 bp, Artificial Sequence
  Description of Artificial Sequence: Synthetic polynucleotide
  modified_base (87)..(92): a, c, t, g, unknown or other
acaacaaccataattctttctatctccacctgttggaggctcatcgttcctattccccccccaggcagatgttatcgaggtccgacnnnnnntccacctttaccccacacctctaaaa

SEQ ID NO: 262 - DNA, 118 bp, Artificial Sequence
  Description of Artificial Sequence: Synthetic polynucleotide
  modified_base (87)..(92): a, c, t, g, unknown or other
atacccctcatacaactaatcaaccgttggaggctcatcgttcctattccccccccccccccaggcagatgttatcgaggtccgacnnnnnnactaaacaatataaattaccaaccct

SEQ ID NO: 263 - DNA, 118 bp, Artificial Sequence
  Description of Artificial Sequence: Synthetic polynucleotide
  modified_base (86)..(91): a, c, t, g, unknown or other
tctccctccctctcccaaatccccgttggaggctcatcgttcctattccccccccccccccaggcagatgttatcgaggtccgacnnnnnnaaacaaattatacaaatataacaattt

SEQ ID NO: 264 - DNA, 118 bp, Artificial Sequence
  Description of Artificial Sequence: Synthetic polynucleotide
  modified_base (93)..(98): a, c, t, g, unknown or other
caactcctcacctaaatttaaagttggaggctcatcgttcctattcccccccccccccccccccccccaggcagatgttatcgaggtccgacnnnnnnaaactaacatcctaactctt

SEQ ID NO: 265 - DNA, 118 bp, Artificial Sequence
  Description of Artificial Sequence: Synthetic polynucleotide
  modified_base (90)..(95): a, c, t, g, unknown or other
accttttccccaaatactcagttggaggctcatcgttcctattccccccccccccccccccccccaggcagatgttatcgaggtccgacnnnnnnaaaaattaccaaaataaacacat

SEQ ID NO: 266 - DNA, 118 bp, Artificial Sequence
  Description of Artificial Sequence: Synthetic polynucleotide
  modified_base (90)..(95): a, c, t, g, unknown or other
acttctccctatatccccacataatcttgttggaggctcatcgttcctattccccccccccccccaggcagatgttatcgaggtccgacnnnnnntcacaatctttaaaactataaat

SEQ ID NO: 267 - DNA, 118 bp, Artificial Sequence
  Description of Artificial Sequence: Synthetic polynucleotide
  modified_base (83)..(88): a, c, t, g, unknown or other
acaaaaacctacactaaaagttggaggctcatcgttcctattccccccccccccccccaggcagatgttatcgaggtccgacnnnnnntcaccttaaaactactcacctccttcttct

SEQ ID NO: 268 - DNA, 118 bp, Artificial Sequence
  Description of Artificial Sequence: Synthetic polynucleotide
  modified_base (91)..(96): a, c, t, g, unknown or other
aataaaatttaaaccccaccgttggaggctcatcgttcctattcccccccccccccccccccccccaggcagatgttatcgaggtccgacnnnnnnactttctccctataaaataaaa

SEQ ID NO: 269 - DNA, 118 bp, Artificial Sequence
  Description of Artificial Sequence: Synthetic polynucleotide
  modified_base (84)..(89): a, c, t, g, unknown or other
atcatcatcccaatacaaaccttccccgttggaggctcatcgttcctattcccccccccaggcagatgttatcgaggtccgacnnnnnntaaattttctttttatcttaacacaaaaa

SEQ ID NO: 270 - DNA, 118 bp, Artificial Sequence
  Description of Artificial Sequence: Synthetic polynucleotide
  modified_base (93)..(98): a, c, t, g, unknown or other
caaatctccttactaaacatcttaagttggaggctcatcgttcctattccccccccccccccccccccaggcagatgttatcgaggtccgacnnnnnnaactaaaattccactaaaca

SEQ ID NO: 271 - DNA, 118 bp, Artificial Sequence
  Description of Artificial Sequence: Synthetic polynucleotide
  modified_base (89)..(94): a, c, t, g, unknown or other
atataatcctaattccccaaaattcccaagttggaggctcatcgttcctattccccccccccccaggcagatgttatcgaggtccgacnnnnnnattccctattaccaaacatttaaa

SEQ ID NO: 272 - DNA, 118 bp, Artificial Sequence
  Description of Artificial Sequence: Synthetic polynucleotide
  modified_base (95)..(100): a, c, t, g, unknown or other
acaccaacacaaaacaagttggaggctcatcgttcctattccccccccccccccccccccccccccccccaggcagatgttatcgaggtccgacnnnnnnctcttcctacacacacac

SEQ ID NO: 273 - DNA, 118 bp, Artificial Sequence
  Description of Artificial Sequence: Synthetic polynucleotide
  modified_base (94)..(99): a, c, t, g, unknown or other
tcacaaacctctaataaaaatatctctgttggaggctcatcgttcctattcccccccccccccccccccaggcagatgttatcgaggtccgacnnnnnnaaaataaaaccctacctca

SEQ ID NO: 274 - DNA, 118 bp, Artificial Sequence
  Description of Artificial Sequence: Synthetic polynucleotide
  modified_base (93)..(98): a, c, t, g, unknown or other
cattttccaacacctaaccccaacgttggaggctcatcgttcctattcccccccccccccccccccccaggcagatgttatcgaggtccgacnnnnnnaactctctctcctacaaaaa

SEQ ID NO: 275 - DNA, 118 bp, Artificial Sequence
  Description of Artificial Sequence: Synthetic polynucleotide
  modified_base (92)..(97): a, c, t, g, unknown or other
acaccaaattcacctacgttggaggctcatcgttcctattcccccccccccccccccccccccccccaggcagatgttatcgaggtccgacnnnnnnaaacactaaaaacttacaaaa

SEQ ID NO: 276 - DNA, 118 bp, Artificial Sequence
  Description of Artificial Sequence: Synthetic polynucleotide
  modified_base (91)..(96): a, c, t, g, unknown or other
ccctacacaaaaactactaaaagttggaggctcatcgttcctattcccccccccccccccccccccaggcagatgttatcgaggtccgacnnnnnncttcactttaaaacattttatc

SEQ ID NO: 277 - DNA, 118 bp, Artificial Sequence
  Description of Artificial Sequence: Synthetic polynucleotide
  modified_base (87)..(92): a, c, t, g, unknown or other
cctcctatccaaacctgttggaggctcatcgttcctattcccccccccccccccccccccccaggcagatgttatcgaggtccgacnnnnnnaaaactaattttaataacaataattt

SEQ ID NO: 278 - DNA, 118 bp, Artificial Sequence
  Description of Artificial Sequence: Synthetic polynucleotide
  modified_base (94)..(99): a, c, t, g, unknown or other
ataccaaaccataacactcgttggaggctcatcgttcctattcccccccccccccccccccccccccccaggcagatgttatcgaggtccgacnnnnnnatttccaaccctttaacca

SEQ ID NO: 279 - DNA, 118 bp, Artificial Sequence
  Description of Artificial Sequence: Synthetic polynucleotide
  modified_base (88)..(93): a, c, t, g, unknown or other
acctacacaaactacaaatttataagttggaggctcatcgttcctattcccccccccccccccaggcagatgttatcgaggtccgacnnnnnnttaaatttcccctactatactataa

SEQ ID NO: 280 - DNA, 118 bp, Artificial Sequence
  Description of Artificial Sequence: Synthetic polynucleotide
  modified_base (83)..(88): a, c, t, g, unknown or other
acaaaatcaactaaccccctcccaaccagttggaggctcatcgttcctattcccccccaggcagatgttatcgaggtccgacnnnnnnatctataatttctttaatatttatttctat

SEQ ID NO: 281 - DNA, 118 bp, Artificial Sequence
  Description of Artificial Sequence: Synthetic polynucleotide
  modified_base (81)..(86): a, c, t, g, unknown or other
acccacctcatctcccacctgttggaggctcatcgttcctattcccccccccccccaggcagatgttatcgaggtccgacnnnnnntatataaatccctctacctttatactttacca

SEQ ID NO: 282 - DNA, 118 bp, Artificial Sequence
  Description of Artificial Sequence: Synthetic polynucleotide
  modified_base (96)..(101): a, c, t, g, unknown or other
caaaactcaaacctaactcatctcgttggaggctcatcgttcctattccccccccccccccccccccccccaggcagatgttatcgaggtccgacnnnnnnaaaaccaaacccaaaaa

SEQ ID NO: 283 - DNA, 118 bp, Artificial Sequence
  Description of Artificial Sequence: Synthetic polynucleotide
  modified_base (89)..(94): a, c, t, g, unknown or other
attccttccccaccacaatcacaaatacacgttggaggctcatcgttcctattcccccccccccaggcagatgttatcgaggtccgacnnnnnnaaataactaaaatttatttctcca

SEQ ID NO: 284 - DNA, 118 bp, Artificial Sequence
  Description of Artificial Sequence: Synthetic polynucleotide
  modified_base (81)..(86): a, c, t, g, unknown or other
acctctccccttaaataactaaaaatccaaatgttggaggctcatcgttcctattcaggcagatgttatcgaggtccgacnnnnnnttaaatttctcccaaccttactccctaccttt

SEQ ID NO: 285 - DNA, 118 bp, Artificial Sequence
  Description of Artificial Sequence: Synthetic polynucleotide
  modified_base (93)..(98): a, c, t, g, unknown or other
tcaccaaactctactccctcacatactatagttggaggctcatcgttcctattcccccccccccccccaggcagatgttatcgaggtccgacnnnnnnttattaaccaaaacctacac

SEQ ID NO: 286 - DNA, 118 bp, Artificial Sequence
  Description of Artificial Sequence: Synthetic polynucleotide
  modified_base (93)..(98): a, c, t, g, unknown or other
accatcctaatcccacagttggaggctcatcgttcctattccccccccccccccccccccccccccccaggcagatgttatcgaggtccgacnnnnnnatactcactaatacatctct

SEQ ID NO: 287 - DNA, 118 bp, Artificial Sequence
  Description of Artificial Sequence: Synthetic polynucleotide
  modified_base (90)..(95): a, c, t, g, unknown or other
ttttaatcctcacaacaacccgttggaggctcatcgttcctattcccccccccccccccccccccaggcagatgttatcgaggtccgacnnnnnnttaaaaacaccttaaattaaaaa

SEQ ID NO: 288 - DNA, 118 bp, Artificial Sequence
  Description of Artificial Sequence: Synthetic polynucleotide
  modified_base (89)..(94): a, c, t, g, unknown or other
cctttcctcaactatctcgttggaggctcatcgttcctattcccccccccccccccccccccccaggcagatgttatcgaggtccgacnnnnnntaaaatttcctttataaactcaaa

SEQ ID NO: 289 - DNA, 118 bp, Artificial Sequence
  Description of Artificial Sequence: Synthetic polynucleotide
  modified_base (97)..(102): a, c, t, g, unknown or other
acaacctccaccattagttggaggctcatcgttcctattcccccccccccccccccccccccccccccccccaggcagatgttatcgaggtccgacnnnnnnactcccacccaacatt

SEQ ID NO: 290 - DNA, 118 bp, Artificial Sequence
  Description of Artificial Sequence: Synthetic polynucleotide
  modified_base (89)..(94): a, c, t, g, unknown or other
ccccctctaactcatactaacaatcttcttccgttggaggctcatcgttcctattcccccccccaggcagatgttatcgaggtccgacnnnnnnaaccaaatcatctaataaaaataa

SEQ ID NO: 291 - DNA, 118 bp, Artificial Sequence
  Description of Artificial Sequence: Synthetic polynucleotide
  modified_base (94)..(99): a, c, t, g, unknown or other
cttcctactatttaaaccacaagttggaggctcatcgttcctattccccccccccccccccccccccccaggcagatgttatcgaggtccgacnnnnnnaaaaacccaactaacttcc

SEQ ID NO: 292 - DNA, 118 bp, Artificial Sequence
  Description of Artificial Sequence: Synthetic polynucleotide
  modified_base (92)..(97): a, c, t, g, unknown or other
ccaaaataaccctaaaaataacgttggaggctcatcgttcctattccccccccccccccccccccccaggcagatgttatcgaggtccgacnnnnnntctacaaacaaataaacaaca

SEQ ID NO: 293 - DNA, 118 bp, Artificial Sequence
  Description of Artificial Sequence: Synthetic polynucleotide
  modified_base (92)..(97): a, c, t, g, unknown or other
acctttaccattctatacagttggaggctcatcgttcctattcccccccccccccccccccccccccaggcagatgttatcgaggtccgacnnnnnntttcccaactaactaaaacca

SEQ ID NO: 294 - DNA, 118 bp, Artificial Sequence
  Description of Artificial Sequence: Synthetic polynucleotide
  modified_base (84)..(89): a, c, t, g, unknown or other
accaaaacctccctaccccagttggaggctcatcgttcctattccccccccccccccccaggcagatgttatcgaggtccgacnnnnnnaaaaataatttacataaaatatttaaaaa

SEQ ID NO: 295 - DNA, 118 bp, Artificial Sequence
  Description of Artificial Sequence: Synthetic polynucleotide
  modified_base (88)..(93): a, c, t, g, unknown or other
atactctaaaacctcctttttaaaatgttggaggctcatcgttcctattccccccccccccccaggcagatgttatcgaggtccgacnnnnnntttaaatttttcccaaaactattaa

SEQ ID NO: 296 - DNA, 118 bp, Artificial Sequence
  Description of Artificial Sequence: Synthetic polynucleotide
  modified_base (92)..(97): a, c, t, g, unknown or other
tcaaaccatatcaaactttctaacgttggaggctcatcgttcctattccccccccccccccccccccaggcagatgttatcgaggtccgacnnnnnnaaaacaaaataacttcaaaac

SEQ ID NO: 297 - DNA, 118 bp, Artificial Sequence
  Description of Artificial Sequence: Synthetic polynucleotide
  modified_base (92)..(97): a, c, t, g, unknown or other
acaaaatctttctcaccaacccttcccccgttggaggctcatcgttcctattcccccccccccccccaggcagatgttatcgaggtccgacnnnnnnaaaaactccaacctataaaaa

SEQ ID NO: 298 - DNA, 118 bp, Artificial Sequence
  Description of Artificial Sequence: Synthetic polynucleotide
  modified_base (89)..(94): a, c, t, g, unknown or other
ctcacactcttaaacaatcatgttggaggctcatcgttcctattccccccccccccccccccccaggcagatgttatcgaggtccgacnnnnnnaataacttaaataaatcataaacc

SEQ ID NO: 299 - DNA, 118 bp, Artificial Sequence
  Description of Artificial Sequence: Synthetic polynucleotide
  modified_base (88)..(93): a, c, t, g, unknown or other
acatcaccaacccacaaccaaaagttggaggctcatcgttcctattcccccccccccccccccaggcagatgttatcgaggtccgacnnnnnnaatatcaaaaatctaaacccaacat

SEQ ID NO: 300 - DNA, 118 bp, Artificial Sequence
  Description of Artificial Sequence: Synthetic polynucleotide
  modified_base (90)..(95): a, c, t, g, unknown or other
ccacacctaaatcaaaactgttggaggctcatcgttcctattcccccccccccccccccccccccaggcagatgttatcgaggtccgacnnnnnnttaatctaaactctctttaaaat

SEQ ID NO: 301 - DNA, 118 bp, Artificial Sequence
  Description of Artificial Sequence: Synthetic polynucleotide
  modified_base (91)..(96): a, c, t, g, unknown or other
ccttaaaaacacaaaaacaagttggaggctcatcgttcctattcccccccccccccccccccccccaggcagatgttatcgaggtccgacnnnnnnactcttacctctaattattaaa

SEQ ID NO: 302 - DNA, 118 bp, Artificial Sequence
  Description of Artificial Sequence: Synthetic polynucleotide
  modified_base (95)..(100): a, c, t, g, unknown or other
ctaactccctccccacccgttggaggctcatcgttcctattcccccccccccccccccccccccccccccaggcagatgttatcgaggtccgacnnnnnnaaacctcaaaacctacta

SEQ ID NO: 303 - DNA, 118 bp, Artificial Sequence
  Description of Artificial Sequence: Synthetic polynucleotide
  modified_base (89)..(94): a, c, t, g, unknown or other
ctcccaaattctcaaaccgttggaggctcatcgttcctattcccccccccccccccccccccccaggcagatgttatcgaggtccgacnnnnnntttcataactaaaccaaaaatcta

SEQ ID NO: 304 - DNA, 118 bp, Artificial Sequence
  Description of Artificial Sequence: Synthetic polynucleotide
  modified_base (93)..(98): a, c, t, g, unknown or other
ctcctttcaacttcccctgttggaggctcatcgttcctattcccccccccccccccccccccccccccaggcagatgttatcgaggtccgacnnnnnnaaacaacctaacatctaatt

SEQ ID NO: 305 - DNA, 118 bp, Artificial Sequence
  Description of Artificial Sequence: Synthetic polynucleotide
  modified_base (90)..(95): a, c, t, g, unknown or other
tccccactaaaatcacacgttggaggctcatcgttcctattccccccccccccccccccccccccaggcagatgttatcgaggtccgacnnnnnnaacaaatatcctaatcctaaaca

SEQ ID NO: 306 - DNA, 118 bp, Artificial Sequence
  Description of Artificial Sequence: Synthetic polynucleotide
  modified_base (86)..(91): a, c, t, g, unknown or other
tcctacctcatcctctctgttggaggctcatcgttcctattccccccccccccccccccccaggcagatgttatcgaggtccgacnnnnnntttttaaaataaaatcttactctctta

SEQ ID NO: 307 - DNA, 118 bp, Artificial Sequence
  Description of Artificial Sequence: Synthetic polynucleotide
  modified_base (86)..(91): a, c, t, g, unknown or other
atttacctatccaaaatcaagttggaggctcatcgttcctattccccccccccccccccccaggcagatgttatcgaggtccgacnnnnnnttactaaatttatattcccattttaaa

SEQ ID NO: 308 - DNA, 118 bp, Artificial Sequence
  Description of Artificial Sequence: Synthetic polynucleotide
  modified_base (87)..(92): a, c, t, g, unknown or other
accttctaaacaaaacaaacctccctgttggaggctcatcgttcctattcccccccccccccaggcagatgttatcgaggtccgacnnnnnntttccctaaatatccattctaaaatt

SEQ ID NO: 309 - DNA, 118 bp, Artificial Sequence
  Description of Artificial Sequence: Synthetic polynucleotide
  modified_base (87)..(92): a, c, t, g, unknown or other
atatatttcaaatcaaacacaaccattgttggaggctcatcgttcctattccccccccccccaggcagatgttatcgaggtccgacnnnnnntttaacacaatccttaaaacctcaac

SEQ ID NO: 310 - DNA, 118 bp, Artificial Sequence
  Description of Artificial Sequence: Synthetic polynucleotide
  modified_base (93)..(98): a, c, t, g, unknown or other
actttaccctaaaacctccgttggaggctcatcgttcctattccccccccccccccccccccccccccaggcagatgttatcgaggtccgacnnnnnntacctacaaaaacaaaacta

SEQ ID NO: 311 - DNA, 118 bp, Artificial Sequence; identical to SEQ ID NO: 289
  Description of Artificial Sequence: Synthetic polynucleotide
  modified_base (97)..(102): a, c, t, g, unknown or other

SEQ ID NO: 312 - DNA, 118 bp, Artificial Sequence
  Description of Artificial Sequence: Synthetic polynucleotide
  modified_base (88)..(93): a, c, t, g, unknown or other
cacacctaactctatccgttggaggctcatcgttcctattcccccccccccccccccccccccaggcagatgttatcgaggtccgacnnnnnnaatacaaaacccaacataacctaaa

SEQ ID NO: 313 - DNA, 118 bp, Artificial Sequence
  Description of Artificial Sequence: Synthetic polynucleotide
  modified_base (94)..(99): a, c, t, g, unknown or other
cccacccaccaaaaatgttggaggctcatcgttcctattccccccccccccccccccccccccccccccaggcagatgttatcgaggtccgacnnnnnnaaaaccaaaaccctaattt

SEQ ID NO: 314 - DNA, 118 bp, Artificial Sequence
  Description of Artificial Sequence: Synthetic polynucleotide
  modified_base (90)..(95): a, c, t, g, unknown or other
cctaaaccattaaacttccgttggaggctcatcgttcctattcccccccccccccccccccccccaggcagatgttatcgaggtccgacnnnnnnttaaaccctataataaacaaaaa

SEQ ID NO: 315 - DNA, 118 bp, Artificial Sequence
  Description of Artificial Sequence: Synthetic polynucleotide
  modified_base (92)..(97): a, c, t, g, unknown or other
tctacaacaactaactcctacccctgttggaggctcatcgttcctattcccccccccccccccccccaggcagatgttatcgaggtccgacnnnnnnaatacaacaataacaaaacaa

SEQ ID NO: 316 - DNA, 118 bp, Artificial Sequence
  Description of Artificial Sequence: Synthetic polynucleotide
  modified_base (85)..(90): a, c, t, g, unknown or other
atcacaattataatttatctccgttggaggctcatcgttcctattcccccccccccccccaggcagatgttatcgaggtccgacnnnnnntttctaataaaacttaaaatataatttt

SEQ ID NO: 317 - DNA, 118 bp, Artificial Sequence
  Description of Artificial Sequence: Synthetic polynucleotide
  modified_base (90)..(95): a, c, t, g, unknown or other
actaacccctactacccaccctatctcaatagttggaggctcatcgttcctattcccccccccccaggcagatgttatcgaggtccgacnnnnnnatttctataaacaaattaatccc

SEQ ID NO: 318 - DNA, 118 bp, Artificial Sequence
  Description of Artificial Sequence: Synthetic polynucleotide
  modified_base (91)..(96): a, c, t, g, unknown or other
cctaaacaaactaaaattctcgttggaggctcatcgttcctattccccccccccccccccccccccaggcagatgttatcgaggtccgacnnnnnntaccctaccaaactcaaacaaa

SEQ ID NO: 319 - DNA, 118 bp, Artificial Sequence
  Description of Artificial Sequence: Synthetic polynucleotide
  modified_base (90)..(95): a, c, t, g, unknown or other
tccccttcccaaccttcctaataaactaaccgttggaggctcatcgttcctattcccccccccccaggcagatgttatcgaggtccgacnnnnnntatactcaaaaactcctacaaaa

SEQ ID NO: 320 - DNA, 118 bp, Artificial Sequence
  Description of Artificial Sequence: Synthetic polynucleotide
  modified_base (86)..(91): a, c, t, g, unknown or other
accttatcaaataccccactgttggaggctcatcgttcctattccccccccccccccccccaggcagatgttatcgaggtccgacnnnnnnacatataaatattcattatttcaattt

SEQ ID NO: 321 - DNA, 118 bp, Artificial Sequence
  Description of Artificial Sequence: Synthetic polynucleotide
  modified_base (86)..(91): a, c, t, g, unknown or other
ataaaaccccaaccaccctcttccaaccgttggaggctcatcgttcctattccccccccccaggcagatgttatcgaggtccgacnnnnnntttataaataaaacatttacaataaaa

SEQ ID NO: 322 - DNA, 118 bp, Artificial Sequence
  Description of Artificial Sequence: Synthetic polynucleotide
  modified_base (92)..(97): a, c, t, g, unknown or other
atccattaaaatttccccgttggaggctcatcgttcctattccccccccccccccccccccccccccaggcagatgttatcgaggtccgacnnnnnncactcaaccattataaattca

SEQ ID NO: 323 - DNA, 118 bp, Artificial Sequence
  Description of Artificial Sequence: Synthetic polynucleotide
  modified_base (93)..(98): a, c, t, g, unknown or other
acacacacacacaaatatagttggaggctcatcgttcctattccccccccccccccccccccccccccaggcagatgttatcgaggtccgacnnnnnnaaacaacttctaaacaaaaa

SEQ ID NO: 324 - DNA, 118 bp, Artificial Sequence
  Description of Artificial Sequence: Synthetic polynucleotide
  modified_base (89)..(94): a, c, t, g, unknown or other
actaaactaacaaaaattacataacctcagttggaggctcatcgttcctattccccccccccccaggcagatgttatcgaggtccgacnnnnnntccaaataaaataaactcaataaa

SEQ ID NO: 325 - DNA, 118 bp, Artificial Sequence
  Description of Artificial Sequence: Synthetic polynucleotide
  modified_base (91)..(96): a, c, t, g, unknown or other
taaacctcattccaaaattatgttggaggctcatcgttcctattccccccccccccccccccccccaggcagatgttatcgaggtccgacnnnnnnccccttcccacacacccctacc

SEQ ID NO: 326 - DNA, 118 bp, Artificial Sequence
  Description of Artificial Sequence: Synthetic polynucleotide
  modified_base (90)..(95): a, c, t, g, unknown or other
cattttccctaacaaaaattttgttggaggctcatcgttcctattccccccccccccccccccccaggcagatgttatcgaggtccgacnnnnnntctacaaataacactccattttt

SEQ ID NO: 327 - DNA, 118 bp, Artificial Sequence
  Description of Artificial Sequence: Synthetic polynucleotide
  modified_base (89)..(94): a, c, t, g, unknown or other
ccctaaataaaaaccacaagttggaggctcatcgttcctattccccccccccccccccccccccaggcagatgttatcgaggtccgacnnnnnntttaactataacttcaataaacta

SEQ ID NO: 328 - DNA, 118 bp, Artificial Sequence
  Description of Artificial Sequence: Synthetic polynucleotide
  modified_base (91)..(96): a, c, t, g, unknown or other
acaccctcaatacaacttataccctctctccgttggaggctcatcgttcctattccccccccccccaggcagatgttatcgaggtccgacnnnnnnaaaaacattactccctaatact

SEQ ID NO: 329 - DNA, 118 bp, Artificial Sequence
  Description of Artificial Sequence: Synthetic polynucleotide
  modified_base (92)..(97): a, c, t, g, unknown or other
acccatttctctaacatttaccatacaccagttggaggctcatcgttcctattccccccccccccccaggcagatgttatcgaggtccgacnnnnnnttcctattctcaaaaacttat

SEQ ID NO: 330 - DNA, 118 bp, Artificial Sequence
  Description of Artificial Sequence: Synthetic polynucleotide
  modified_base (88)..(93): a, c, t, g, unknown or other
ccaaaacctactcactacgttggaggctcatcgttcctattccccccccccccccccccccccaggcagatgttatcgaggtccgacnnnnnnactaaaaactatttctaaattttac

SEQ ID NO: 331 - DNA, 118 bp, Artificial Sequence
  Description of Artificial Sequence: Synthetic polynucleotide
  modified_base (95)..(100): a, c, t, g, unknown or other
ctcccccttctccatacgttggaggctcatcgttcctattccccccccccccccccccccccccccccccaggcagatgttatcgaggtccgacnnnnnntcaaaacaatcaactccc

SEQ ID NO: 332 - DNA, 118 bp, Artificial Sequence
  Description of Artificial Sequence: Synthetic polynucleotide
  modified_base (93)..(98): a, c, t, g, unknown or other
cactaaacttcctactactttgttggaggctcatcgttcctattccccccccccccccccccccccccaggcagatgttatcgaggtccgacnnnnnnactatcctctaaaccaaaaa

SEQ ID NO: 333 - DNA, 118 bp, Artificial Sequence
  Description of Artificial Sequence: Synthetic polynucleotide
  modified_base (88)..(93): a, c, t, g, unknown or other
actcccaactttaccactgttggaggctcatcgttcctattccccccccccccccccccccccaggcagatgttatcgaggtccgacnnnnnnataccattctaacaattacaaatct

SEQ ID NO: 334 - DNA, 118 bp, Artificial Sequence
  Description of Artificial Sequence: Synthetic polynucleotide
  modified_base (93)..(98): a, c, t, g, unknown or other
ccacacctaactaattttcgttggaggctcatcgttcctattccccccccccccccccccccccccccaggcagatgttatcgaggtccgacnnnnnnaactatactactaccatctc

SEQ ID NO: 335 - DNA, 118 bp, Artificial Sequence
  Description of Artificial Sequence: Synthetic polynucleotide
  modified_base (86)..(91): a, c, t, g, unknown or other
atcactcctcatcaaaaagttggaggctcatcgttcctattccccccccccccccccccccaggcagatgttatcgaggtccgacnnnnnnaaataaaaactaaactaaatataaaaa

SEQ ID NO: 336 - DNA, 118 bp, Artificial Sequence
  Description of Artificial Sequence: Synthetic polynucleotide
  modified_base (94)..(99): a, c, t, g, unknown or other
cactctaacctctaaacctaaatgttggaggctcatcgttcctattcccccccccccccccccccccccaggcagatgttatcgaggtccgacnnnnnnttactcaacaaccaactct

SEQ ID NO: 337 - DNA, 118 bp, Artificial Sequence
  Description of Artificial Sequence: Synthetic polynucleotide
  modified_base (91)..(96): a, c, t, g, unknown or other
ccttttaaaaacctcctcagttggaggctcatcgttcctattccccccccccccccccccccccccaggcagatgttatcgaggtccgacnnnnnnactccctacataaaaactaaaa

SEQ ID NO: 338 - DNA, 118 bp, Artificial Sequence
  Description of Artificial Sequence: Synthetic polynucleotide
  modified_base (89)..(94): a, c, t, g, unknown or other
atacaaaaacaacatcttcctgttggaggctcatcgttcctattccccccccccccccccccccaggcagatgttatcgaggtccgacnnnnnnaacatttaatttcttactttaaaa

SEQ ID NO: 339 - DNA, 118 bp, Artificial Sequence
  Description of Artificial Sequence: Synthetic polynucleotide
  modified_base (94)..(99): a, c, t, g, unknown or other
accatcctaccataccccgttggaggctcatcgttcctattccccccccccccccccccccccccccccaggcagatgttatcgaggtccgacnnnnnntttctaataaacctcctct

SEQ ID NO: 340 - DNA, 118 bp, Artificial Sequence
  Description of Artificial Sequence: Synthetic polynucleotide
  modified_base (90)..(95): a, c, t, g, unknown or other
ctccttatacaaaataccaaagttggaggctcatcgttcctattcccccccccccccccccccccaggcagatgttatcgaggtccgacnnnnnntttatttcttaaaaactcacaaa

SEQ ID NO: 341 - DNA, 118 bp, Artificial Sequence
  Description of Artificial Sequence: Synthetic polynucleotide
  modified_base (86)..(91): a, c, t, g, unknown or other
ttcctctatatattctacaaaaagttggaggctcatcgttcctattcccccccccccccccaggcagatgttatcgaggtccgacnnnnnntcccataacccctatacccctaaaccc

SEQ ID NO: 342 - DNA, 118 bp, Artificial Sequence
  Description of Artificial Sequence: Synthetic polynucleotide
  modified_base (91)..(96): a, c, t, g, unknown or other
actcactaaatcaaacaccctaagttggaggctcatcgttcctattccccccccccccccccccccaggcagatgttatcgaggtccgacnnnnnntccattattaatttctaaaacc

SEQ ID NO: 343 - DNA, 118 bp, Artificial Sequence
  Description of Artificial Sequence: Synthetic polynucleotide
  modified_base (87)..(92): a, c, t, g, unknown or other
attttaaaactataaaaactaaacttcgttggaggctcatcgttcctattccccccccccccaggcagatgttatcgaggtccgacnnnnnnttttaaaactccacaataaaaatttt

SEQ ID NO: 344 - DNA, 118 bp, Artificial Sequence
  Description of Artificial Sequence: Synthetic polynucleotide
  modified_base (83)..(88): a, c, t, g, unknown or other
atctaaactacccaactaattaaaaccatagttggaggctcatcgttcctattcccccaggcagatgttatcgaggtccgacnnnnnntatatattttataaataaaaataaacccca

SEQ ID NO: 345 - DNA, 118 bp, Artificial Sequence
  Description of Artificial Sequence: Synthetic polynucleotide
  modified_base (96)..(101): a, c, t, g, unknown or other
acaaatcctacttcctcgttggaggctcatcgttcctattcccccccccccccccccccccccccccccccaggcagatgttatcgaggtccgacnnnnnnaaacccaaccacctcta

SEQ ID NO: 346 - DNA, 118 bp, Artificial Sequence
  Description of Artificial Sequence: Synthetic polynucleotide
  modified_base (89)..(94): a, c, t, g, unknown or other
acccccactccaaactaaacctacctttctttgttggaggctcatcgttcctattcccccccccaggcagatgttatcgaggtccgacnnnnnnttccctcccaaccctataaaactt

SEQ ID NO: 347 - DNA, 118 bp, Artificial Sequence
  Description of Artificial Sequence: Synthetic polynucleotide
  modified_base (89)..(94): a, c, t, g, unknown or other
ccttcctctctctaactgttggaggctcatcgttcctattccccccccccccccccccccccccaggcagatgttatcgaggtccgacnnnnnntaaataacttatttctaaccaaaa

SEQ ID NO: 348 - DNA, 118 bp, Artificial Sequence
  Description of Artificial Sequence: Synthetic polynucleotide
  modified_base (91)..(96): a, c, t, g, unknown or other
cctactaaacccctactacgttggaggctcatcgttcctattccccccccccccccccccccccccaggcagatgttatcgaggtccgacnnnnnnaaaatcttaaataaccctatct

SEQ ID NO: 349 - DNA, 118 bp, Artificial Sequence
  Description of Artificial Sequence: Synthetic polynucleotide
  modified_base (90)..(95): a, c, t, g, unknown or other
acacactttcactctttttacccaaactaaacgttggaggctcatcgttcctattccccccccccaggcagatgttatcgaggtccgacnnnnnnaacctaaaaccctcaccatccta

SEQ ID NO: 350 - DNA, 118 bp, Artificial Sequence
  Description of Artificial Sequence: Synthetic polynucleotide
  modified_base (88)..(93): a, c, t, g, unknown or other
acaccctccctcttcacaactgttggaggctcatcgttcctattcccccccccccccccccccaggcagatgttatcgaggtccgacnnnnnnttaaccaacacctaacatcataaaa

SEQ ID NO: 351 - DNA, 118 bp, Artificial Sequence
  Description of Artificial Sequence: Synthetic polynucleotide
  modified_base (87)..(92): a, c, t, g, unknown or other
tatttctccctttaaattctaaaagttggaggctcatcgttcctattcccccccccccccccaggcagatgttatcgaggtccgacnnnnnntcctaaacctaacccctcatccaaaa

SEQ ID NO: 352 - DNA, 118 bp, Artificial Sequence
  Description of Artificial Sequence: Synthetic polynucleotide
  modified_base (91)..(96): a, c, t, g, unknown or other
ctacaaacacttttccacgttggaggctcatcgttcctattcccccccccccccccccccccccccaggcagatgttatcgaggtccgacnnnnnntctaaattttaaaaccctaaaa

SEQ ID NO: 353 - DNA, 118 bp, Artificial Sequence
  Description of Artificial Sequence: Synthetic polynucleotide
  modified_base (91)..(96): a, c, t, g, unknown or other
cacttctctcttccccgttggaggctcatcgttcctattcccccccccccccccccccccccccccaggcagatgttatcgaggtccgacnnnnnnaaacaatttttctttttccatt

SEQ ID NO: 354 - DNA, 118 bp, Artificial Sequence
  Description of Artificial Sequence: Synthetic polynucleotide
  modified_base (87)..(92): a, c, t, g, unknown or other
attctaaaaatatctctaccttcccaaatgttggaggctcatcgttcctattccccccccccaggcagatgttatcgaggtccgacnnnnnntatcatctaaccacccacaactttat

SEQ ID NO: 355 - DNA, 118 bp, Artificial Sequence
  Description of Artificial Sequence: Synthetic polynucleotide
  modified_base (92)..(97): a, c, t, g, unknown or other
aatcaacaacactatatcccgttggaggctcatcgttcctattccccccccccccccccccccccccaggcagatgttatcgaggtccgacnnnnnncattctttcttacttttacaa

SEQ ID NO: 356 - DNA, 118 bp, Artificial Sequence
  Description of Artificial Sequence: Synthetic polynucleotide
  modified_base (89)..(94): a, c, t, g, unknown or other
ccaaactttctctaaatcagttggaggctcatcgttcctattccccccccccccccccccccccaggcagatgttatcgaggtccgacnnnnnnaaaactcacccatctaaataaaaa

SEQ ID NO: 357 - DNA, 118 bp, Artificial Sequence
  Description of Artificial Sequence: Synthetic polynucleotide
  modified_base (93)..(98): a, c, t, g, unknown or other
aaacaatcaaaaattcaaaaagttggaggctcatcgttcctattccccccccccccccccccccccccaggcagatgttatcgaggtccgacnnnnnncctaaataaataaacaaccc

SEQ ID NO: 358 - DNA, 118 bp, Artificial Sequence
  Description of Artificial Sequence: Synthetic polynucleotide
  modified_base (90)..(95): a, c, t, g, unknown or other
tccaaatattctctctaccccagttggaggctcatcgttcctattccccccccccccccccccccaggcagatgttatcgaggtccgacnnnnnnataaaacctaacaaacttattct

SEQ ID NO: 359 - DNA, 118 bp, Artificial Sequence
  Description of Artificial Sequence: Synthetic polynucleotide
  modified_base (93)..(98): a, c, t, g, unknown or other
ccaacctatacaatcctctgttggaggctcatcgttcctattccccccccccccccccccccccccccaggcagatgttatcgaggtccgacnnnnnnaccaactatcaatttctaaa

SEQ ID NO: 360 - DNA, 118 bp, Artificial Sequence
  Description of Artificial Sequence: Synthetic polynucleotide
  modified_base (90)..(95): a, c, t, g, unknown or other
cttcactaccctcttatttgttggaggctcatcgttcctattcccccccccccccccccccccccaggcagatgttatcgaggtccgacnnnnnntaccaaattctttttctaattaa

SEQ ID NO: 361 - DNA, 118 bp, Artificial Sequence
  Description of Artificial Sequence: Synthetic polynucleotide
  modified_base (89)..(94): a, c, t, g, unknown or other
cccctataaatccccctccaaacaaatgttggaggctcatcgttcctattccccccccccccccaggcagatgttatcgaggtccgacnnnnnnaaaaccaaacaaatatttataatt

SEQ ID NO: 362 - DNA, 118 bp, Artificial Sequence
  Description of Artificial Sequence: Synthetic polynucleotide
  modified_base (93)..(98): a, c, t, g, unknown or other
ccctactaaactaaaaacaagttggaggctcatcgttcctattcccccccccccccccccccccccccaggcagatgttatcgaggtccgacnnnnnntaacaccaattacatatcaa

SEQ ID NO: 363 - DNA, 118 bp, Artificial Sequence
  Description of Artificial Sequence: Synthetic polynucleotide
  modified_base (92)..(97): a, c, t, g, unknown or other
actaccctcctcctctcgttggaggctcatcgttcctattcccccccccccccccccccccccccccaggcagatgttatcgaggtccgacnnnnnnaaaaactcaaacaaaatcaaa

SEQ ID NO: 364 - DNA, 118 bp, Artificial Sequence
  Description of Artificial Sequence: Synthetic polynucleotide
  modified_base (89)..(94): a, c, t, g, unknown or other
acacctacacctccctaatccccagttggaggctcatcgttcctattcccccccccccccccccaggcagatgttatcgaggtccgacnnnnnnaatatccctcctatcaaaaatcca

SEQ ID NO: 365 - DNA, 118 bp, Artificial Sequence
  Description of Artificial Sequence: Synthetic polynucleotide
  modified_base (90)..(95): a, c, t, g, unknown or other
cccaactctcccaaaactcgttggaggctcatcgttcctattcccccccccccccccccccccccaggcagatgttatcgaggtccgacnnnnnnaaatccaaaaccttctctctatt

SEQ ID NO: 366 - DNA, 118 bp, Artificial Sequence
  Description of Artificial Sequence: Synthetic polynucleotide
  modified_base (94)..(99): a, c, t, g, unknown or other
caacttttaaacccaaaatcattagttggaggctcatcgttcctattccccccccccccccccccccccaggcagatgttatcgaggtccgacnnnnnnaaaaataccttcctttcct

SEQ ID NO: 367 - DNA, 118 bp, Artificial Sequence
  Description of Artificial Sequence: Synthetic polynucleotide
  modified_base (92)..(97): a, c, t, g, unknown or other
ctctaaaaacaacactccagttggaggctcatcgttcctattcccccccccccccccccccccccccaggcagatgttatcgaggtccgacnnnnnnaaaactaaactacccaattta

SEQ ID NO: 368 - DNA, 118 bp, Artificial Sequence
  Description of Artificial Sequence: Synthetic polynucleotide
  modified_base (91)..(96): a, c, t, g, unknown or other
cttctcaacccaacccgttggaggctcatcgttcctattcccccccccccccccccccccccccccaggcagatgttatcgaggtccgacnnnnnnaacctaccaaccataatcaaaa

SEQ ID NO: 369 - DNA, 118 bp, Artificial Sequence
  Description of Artificial Sequence: Synthetic polynucleotide
  modified_base (90)..(95): a, c, t, g, unknown or other
acaccctcaatacaacttataccctctctcgttggaggctcatcgttcctattccccccccccccaggcagatgttatcgaggtccgacnnnnnnaaaaacattactccctaatacta

SEQ ID NO: 370 - DNA, 118 bp, Artificial Sequence
  Description of Artificial Sequence: Synthetic polynucleotide
  modified_base (92)..(97): a, c, t, g, unknown or other
tactaaaacaaaaccatcatcatctcgttggaggctcatcgttcctattccccccccccccccccccaggcagatgttatcgaggtccgacnnnnnntttctctttaaaacctaacta

SEQ ID NO: 371 - DNA, 118 bp, Artificial Sequence
  Description of Artificial Sequence: Synthetic polynucleotide
  modified_base (86)..(91): a, c, t, g, unknown or other
actatctacaaacccacataaccttatgttggaggctcatcgttcctattcccccccccccaggcagatgttatcgaggtccgacnnnnnnccccaaaatatttaatataattaaatt

SEQ ID NO: 372 - DNA, 118 bp, Artificial Sequence
  Description of Artificial Sequence: Synthetic polynucleotide
  modified_base (91)..(96): a, c, t, g, unknown or other
acacacaccttctccttctccacctgttggaggctcatcgttcctattccccccccccccccccccaggcagatgttatcgaggtccgacnnnnnnaaaaatctcttctctactatct

SEQ ID NO: 373 - DNA, 118 bp, Artificial Sequence
  Description of Artificial Sequence: Synthetic polynucleotide
  modified_base (92)..(97): a, c, t, g, unknown or other
tcctcctttatctaccactaaaagttggaggctcatcgttcctattcccccccccccccccccccccaggcagatgttatcgaggtccgacnnnnnntcctaacacctaccttataaa

SEQ ID NO: 374 - DNA, 118 bp, Artificial Sequence
  Description of Artificial Sequence: Synthetic polynucleotide
  modified_base (84)..(89): a, c, t, g, unknown or other
caaactcaaaattcaaaactgttggaggctcatcgttcctattccccccccccccccccaggcagatgttatcgaggtccgacnnnnnnacactcccaaccctctctatctcacaaat

SEQ ID NO: 375 - DNA, 118 bp, Artificial Sequence
  Description of Artificial Sequence: Synthetic polynucleotide
  modified_base (88)..(93): a, c, t, g, unknown or other
actttaaaacattacaaatttatacccacaaagttggaggctcatcgttcctattccccccccaggcagatgttatcgaggtccgacnnnnnntccttaactaaaaactataaaatat

SEQ ID NO: 376 - DNA, 118 bp, Artificial Sequence
  Description of Artificial Sequence: Synthetic polynucleotide
  modified_base (90)..(95): a, c, t, g, unknown or other
actccttttctctttaaatttcttatttaccagttggaggctcatcgttcctattccccccccccaggcagatgttatcgaggtccgacnnnnnnatccaccaccttaccaataatat

SEQ ID NO: 377 - DNA, 118 bp, Artificial Sequence
  Description of Artificial Sequence: Synthetic polynucleotide
  modified_base (87)..(92): a, c, t, g, unknown or other
atcacaacaacttcctctgttggaggctcatcgttcctattcccccccccccccccccccccaggcagatgttatcgaggtccgacnnnnnnaaacctaaactctttacataccactt

SEQ ID NO: 378 - DNA, 118 bp, Artificial Sequence
  Description of Artificial Sequence: Synthetic polynucleotide
  modified_base (91)..(96): a, c, t, g, unknown or other
acttactcaaaaacaaaaccaaactccccaccgttggaggctcatcgttcctattcccccccccccaggcagatgttatcgaggtccgacnnnnnnaccttccccaaccacccactta

SEQ ID NO: 379 - DNA, 118 bp, Artificial Sequence
  Description of Artificial Sequence: Synthetic polynucleotide
  modified_base (89)..(94): a, c, t, g, unknown or other
acaacctaaatatctcttcagttggaggctcatcgttcctattcccccccccccccccccccccaggcagatgttatcgaggtccgacnnnnnnttattaccaaaatcaaaaactaaa

SEQ ID NO: 380 - DNA, 118 bp, Artificial Sequence
  Description of Artificial Sequence: Synthetic polynucleotide
  modified_base (91)..(96): a, c, t, g, unknown or other
tcaaaacaaaacaactttcctccgttggaggctcatcgttcctattccccccccccccccccccccaggcagatgttatcgaggtccgacnnnnnntaccaactctaaaaactaatat

SEQ ID NO: 381 - DNA, 118 bp, Artificial Sequence
  Description of Artificial Sequence: Synthetic polynucleotide
  modified_base (90)..(95): a, c, t, g, unknown or other
ctaacctctttctcacactgttggaggctcatcgttcctattcccccccccccccccccccccccaggcagatgttatcgaggtccgacnnnnnntaaaccttaattaaaacctctaa

SEQ ID NO: 382 - DNA, 118 bp, Artificial Sequence
  Description of Artificial Sequence: Synthetic polynucleotide
  modified_base (94)..(99): a, c, t, g, unknown or other
acccaaaaacccttccaagttggaggctcatcgttcctattccccccccccccccccccccccccccccaggcagatgttatcgaggtccgacnnnnnnaaaaccacacctcccaaaa

SEQ ID NO: 383 - DNA, 118 bp, Artificial Sequence
  Description of Artificial Sequence: Synthetic polynucleotide
  modified_base (92)..(97): a, c, t, g, unknown or other
caataacactaaaatcaccagttggaggctcatcgttcctattccccccccccccccccccccccccaggcagatgttatcgaggtccgacnnnnnntccctcaataaaactattatt

SEQ ID NO: 384 - DNA, 118 bp, Artificial Sequence
  Description of Artificial Sequence: Synthetic polynucleotide
  modified_base (88)..(93): a, c, t, g, unknown or other
attaatcacacccccatacccacacaccgttggaggctcatcgttcctattccccccccccccaggcagatgttatcgaggtccgacnnnnnntttcctatactttatatcatactcc

SEQ ID NO: 385 - DNA, 118 bp, Artificial Sequence
  Description of Artificial Sequence: Synthetic polynucleotide
  modified_base (92)..(97): a, c, t, g, unknown or other
tcctaataactatactactactatgttggaggctcatcgttcctattccccccccccccccccccccaggcagatgttatcgaggtccgacnnnnnnacccaccttaaataattaaaa

SEQ ID NO: 386 - DNA, 118 bp, Artificial Sequence
  Description of Artificial Sequence: Synthetic polynucleotide
  modified_base (91)..(96): a, c, t, g, unknown or other
taacaaataaaaaccccactcaaagttggaggctcatcgttcctattcccccccccccccccccccaggcagatgttatcgaggtccgacnnnnnntaattaaaacctctaaaaccaa

SEQ ID NO: 387 - DNA, 118 bp, Artificial Sequence
  Description of Artificial Sequence: Synthetic polynucleotide
  modified_base (90)..(95): a, c, t, g, unknown or other
acacaaataattaatccaaactccaaaaaccgttggaggctcatcgttcctattcccccccccccaggcagatgttatcgaggtccgacnnnnnntccaaaactcaaaattctaatat

SEQ ID NO: 388 - DNA, 118 bp, Artificial Sequence
  Description of Artificial Sequence: Synthetic polynucleotide
  modified_base (88)..(93): a, c, t, g, unknown or other
tcaacttaccatatcaataccgttggaggctcatcgttcctattcccccccccccccccccccaggcagatgttatcgaggtccgacnnnnnntttacaataccaaaaataaaaataa

SEQ ID NO: 389 - DNA, 118 bp, Artificial Sequence
  Description of Artificial Sequence: Synthetic polynucleotide
  modified_base (97)..(102): a, c, t, g, unknown or other
acaaacctaatttccaccgttggaggctcatcgttcctattcccccccccccccccccccccccccccccccaggcagatgttatcgaggtccgacnnnnnnaaatccctccccaact

SEQ ID NO: 390 - DNA, 118 bp, Artificial Sequence
  Description of Artificial Sequence: Synthetic polynucleotide
  modified_base (84)..(89): a, c, t, g, unknown or other
cacctcctcctacctagttggaggctcatcgttcctattccccccccccccccccccccaggcagatgttatcgaggtccgacnnnnnntactaataaaactaaattaaaataaaaat

SEQ ID NO: 391 - DNA, 118 bp, Artificial Sequence
  Description of Artificial Sequence: Synthetic polynucleotide
  modified_base (94)..(99): a, c, t, g, unknown or other
cctcaataccacaaacctgttggaggctcatcgttcctattccccccccccccccccccccccccccccaggcagatgttatcgaggtccgacnnnnnnttatctaccacaatcaacc

SEQ ID NO: 392 - DNA, 118 bp, Artificial Sequence
  Description of Artificial Sequence: Synthetic polynucleotide
  modified_base (93)..(98): a, c, t, g, unknown or other
cacccacctcttaaaacccgttggaggctcatcgttcctattccccccccccccccccccccccccccaggcagatgttatcgaggtccgacnnnnnntacttcaacaccttatacaa

SEQ ID NO: 393 - DNA, 118 bp, Artificial Sequence
  Description of Artificial Sequence: Synthetic polynucleotide
  modified_base (88)..(93): a, c, t, g, unknown or other
actcactatctaaactctccagttggaggctcatcgttcctattcccccccccccccccccccaggcagatgttatcgaggtccgacnnnnnnttcctcaattcaacatctataactt

SEQ ID NO: 394 - DNA, 118 bp, Artificial Sequence
  Description of Artificial Sequence: Synthetic polynucleotide
  modified_base (81)..(86): a, c, t, g, unknown or other
aaaccacttcctattacttcatccccgttggaggctcatcgttcctattcccccccaggcagatgttatcgaggtccgacnnnnnntaaaaaccaaaaataactccaaacattacctc

SEQ ID NO: 395 - DNA, 118 bp, Artificial Sequence
  Description of Artificial Sequence: Synthetic polynucleotide
  modified_base (94)..(99): a, c, t, g, unknown or other
acccactacccaaaaacgttggaggctcatcgttcctattcccccccccccccccccccccccccccccaggcagatgttatcgaggtccgacnnnnnnttcccttaaatcaaccact

SEQ ID NO: 396 - DNA, 118 bp, Artificial Sequence
  Description of Artificial Sequence: Synthetic polynucleotide
  modified_base (94)..(99): a, c, t, g, unknown or other
acccacatcaaaacaacgttggaggctcatcgttcctattcccccccccccccccccccccccccccccaggcagatgttatcgaggtccgacnnnnnnaacacaatcaaaaacatct

SEQ ID NO: 397 - DNA, 118 bp, Artificial Sequence
  Description of Artificial Sequence: Synthetic polynucleotide
  modified_base (91)..(96): a, c, t, g, unknown or other
cttcttccaacatatcccgttggaggctcatcgttcctattcccccccccccccccccccccccccaggcagatgttatcgaggtccgacnnnnnntaaatcatcactcaacaccaaa

SEQ ID NO: 398 - DNA, 118 bp, Artificial Sequence
  Description of Artificial Sequence: Synthetic polynucleotide
  modified_base (94)..(99): a, c, t, g, unknown or other
tctccttaccttaaccttaaactacttctagttggaggctcatcgttcctattccccccccccccccccaggcagatgttatcgaggtccgacnnnnnntaataaccactcccttccc

SEQ ID NO: 399 - DNA, 118 bp, Artificial Sequence
  Description of Artificial Sequence: Synthetic polynucleotide
  modified_base (93)..(98): a, c, t, g, unknown or other
cctttaaacaataacctttacaagttggaggctcatcgttcctattccccccccccccccccccccccaggcagatgttatcgaggtccgacnnnnnnactatttcctaaaactctct

SEQ ID NO: 400 - DNA, 118 bp, Artificial Sequence
  Description of Artificial Sequence: Synthetic polynucleotide
  modified_base (89)..(94): a, c, t, g, unknown or other
cctaacatataaaacaacaaacgttggaggctcatcgttcctattcccccccccccccccccccaggcagatgttatcgaggtccgacnnnnnnataaaaactaaacttttattcttt

SEQ ID NO: 401 - DNA, 118 bp, Artificial Sequence
  Description of Artificial Sequence: Synthetic polynucleotide
  modified_base (91)..(96): a, c, t, g, unknown or other
ctcctacaacctaaacacgttggaggctcatcgttcctattcccccccccccccccccccccccccaggcagatgttatcgaggtccgacnnnnnnaaaaatacaaaaactcaaattc

SEQ ID NO: 402 - DNA, 118 bp, Artificial Sequence
  Description of Artificial Sequence: Synthetic polynucleotide
  modified_base (91)..(96): a, c, t, g, unknown or other
acccccaacatttaaaaatgttggaggctcatcgttcctattccccccccccccccccccccccccaggcagatgttatcgaggtccgacnnnnnntaactcccttattacaaacccc

SEQ ID NO: 403 - DNA, 118 bp, Artificial Sequence
  Description of Artificial Sequence: Synthetic polynucleotide
  modified_base (91)..(96): a, c, t, g, unknown or other
atcctaataaatctattctccactaaactagttggaggctcatcgttcctattcccccccccccccaggcagatgttatcgaggtccgacnnnnnntataccattttactcaaaacca

SEQ ID NO: 404 - DNA, 118 bp, Artificial Sequence
  Description of Artificial Sequence: Synthetic polynucleotide
  modified_base (91)..(96): a, c, t, g, unknown or other
actcaaaacaaatcccttcaaccgttggaggctcatcgttcctattccccccccccccccccccccaggcagatgttatcgaggtccgacnnnnnntattccatatacaaaatctctt

SEQ ID NO: 405 - DNA, 118 bp, Artificial Sequence
  Description of Artificial Sequence: Synthetic polynucleotide
  modified_base (93)..(98): a, c, t, g, unknown or other
ctcacaaaccaatatccctatgttggaggctcatcgttcctattccccccccccccccccccccccccaggcagatgttatcgaggtccgacnnnnnnacaacattacaaaaacattt

SEQ ID NO: 406 - DNA, 118 bp, Artificial Sequence
  Description of Artificial Sequence: Synthetic polynucleotide
  modified_base (94)..(99): a, c, t, g, unknown or other
caaacaactaatatttaaataataataagttggaggctcatcgttcctattccccccccccccccccccaggcagatgttatcgaggtccgacnnnnnnaaactctaaaaacttcaca

SEQ ID NO: 407 - DNA, 118 bp, Artificial Sequence
  Description of Artificial Sequence: Synthetic polynucleotide
  modified_base (93)..(98): a, c, t, g, unknown or other
ctctcctctttcttttaaatgttggaggctcatcgttcctattcccccccccccccccccccccccccaggcagatgttatcgaggtccgacnnnnnnaacccaaatactaacttaaa

SEQ ID NO: 408 - DNA, 118 bp, Artificial Sequence
  Description of Artificial Sequence: Synthetic polynucleotide
  modified_base (92)..(97): a, c, t, g, unknown or other
ctacactaaacccaaccgttggaggctcatcgttcctattcccccccccccccccccccccccccccaggcagatgttatcgaggtccgacnnnnnncccaaaataaaacaaataacc

SEQ ID NO: 409 - DNA, 118 bp, Artificial Sequence
  Description of Artificial Sequence: Synthetic polynucleotide
  modified_base (90)..(95): a, c, t, g, unknown or other
ctaatattcctcctacccgttggaggctcatcgttcctattccccccccccccccccccccccccaggcagatgttatcgaggtccgacnnnnnncttactaaataaaactaaaacct

SEQ ID NO: 410 - DNA, 118 bp, Artificial Sequence
  Description of Artificial Sequence: Synthetic polynucleotide
  modified_base (89)..(94): a, c, t, g, unknown or other
cctctaccctctaatccgttggaggctcatcgttcctattccccccccccccccccccccccccaggcagatgttatcgaggtccgacnnnnnnttctccttaaaacttcttcccact

SEQ ID NO: 411 - DNA, 118 bp, Artificial Sequence
  Description of Artificial Sequence: Synthetic polynucleotide
  modified_base (95)..(100): a, c, t, g, unknown or other
tcaaaaacacttcatccatcaatagttggaggctcatcgttcctattcccccccccccccccccccccccaggcagatgttatcgaggtccgacnnnnnnaaacacactaaccaaaaa

SEQ ID NO: 412 - DNA, 118 bp, Artificial Sequence
  Description of Artificial Sequence: Synthetic polynucleotide
  modified_base (90)..(95): a, c, t, g, unknown or other
taaccccctcctttatatcacattctcaaaagttggaggctcatcgttcctattcccccccccccaggcagatgttatcgaggtccgacnnnnnnattccctccctcccactaccaat

SEQ ID NO: 413 - DNA, 118 bp, Artificial Sequence
  Description of Artificial Sequence: Synthetic polynucleotide
  modified_base (89)..(94): a, c, t, g, unknown or other
ctcccttaccctcaatcgttggaggctcatcgttcctattccccccccccccccccccccccccaggcagatgttatcgaggtccgacnnnnnnaccaaaactatatttattaaacaa

SEQ ID NO: 414 - DNA, 118 bp, Artificial Sequence
  Description of Artificial Sequence: Synthetic polynucleotide
  modified_base (88)..(93): a, c, t, g, unknown or other
atccctaaccaaccaaaataacaccgttggaggctcatcgttcctattcccccccccccccccaggcagatgttatcgaggtccgacnnnnnnaattttatcaataaatccaaccctt

SEQ ID NO: 415 - DNA, 118 bp, Artificial Sequence
  Description of Artificial Sequence: Synthetic polynucleotide
  modified_base (92)..(97): a, c, t, g, unknown or other
taatctataactatctttatacctacccgttggaggctcatcgttcctattccccccccccccccccaggcagatgttatcgaggtccgacnnnnnncctaactttatctcctaaaaa

SEQ ID NO: 416 - DNA, 118 bp, Artificial Sequence
  Description of Artificial Sequence: Synthetic polynucleotide
  modified_base (90)..(95): a, c, t, g, unknown or other
ccaaacaaccttttcctagttggaggctcatcgttcctattccccccccccccccccccccccccaggcagatgttatcgaggtccgacnnnnnntaactcaatttctctaaaaacta

SEQ ID NO: 417 - DNA, 118 bp, Artificial Sequence
  Description of Artificial Sequence: Synthetic polynucleotide
  modified_base (93)..(98): a, c, t, g, unknown or other
cctactccacacaaaccgttggaggctcatcgttcctattccccccccccccccccccccccccccccaggcagatgttatcgaggtccgacnnnnnntcctacttcccctaaaactc

SEQ ID NO: 418 - DNA, 118 bp, Artificial Sequence
  Description of Artificial Sequence: Synthetic polynucleotide
  modified_base (95)..(100): a, c, t, g, unknown or other
actaccccttcccttcgttggaggctcatcgttcctattcccccccccccccccccccccccccccccccaggcagatgttatcgaggtccgacnnnnnnaaaaccaactctacaaac

SEQ ID NO: 419 - DNA, 118 bp, Artificial Sequence
  Description of Artificial Sequence: Synthetic polynucleotide
  modified_base (88)..(93): a, c, t, g, unknown or other
ctttctacccccacaagttggaggctcatcgttcctattccccccccccccccccccccccccaggcagatgttatcgaggtccgacnnnnnntaaaactaatacaaaaccttaaaaa

SEQ ID NO: 420 - DNA, 118 bp, Artificial Sequence
  Description of Artificial Sequence: Synthetic polynucleotide
  modified_base (90)..(95): a, c, t, g, unknown or other
ctctcaacctctcaactgttggaggctcatcgttcctattcccccccccccccccccccccccccaggcagatgttatcgaggtccgacnnnnnntttttacacactactattataac

SEQ ID NO: 421 - DNA, 118 bp, Artificial Sequence
  Description of Artificial Sequence: Synthetic polynucleotide
  modified_base (88)..(93): a, c, t, g, unknown or other
ccaaccttacatacctcgttggaggctcatcgttcctattcccccccccccccccccccccccaggcagatgttatcgaggtccgacnnnnnnaaaaatcaattcttcttattaaaat

SEQ ID NO: 422 - DNA, 118 bp, Artificial Sequence
  Description of Artificial Sequence: Synthetic polynucleotide
  modified_base (91)..(96): a, c, t, g, unknown or other
ccatcaacatacttaaacccgttggaggctcatcgttcctattcccccccccccccccccccccccaggcagatgttatcgaggtccgacnnnnnntctaaccaacttttaaaaactt

SEQ ID NO: 423 - DNA, 118 bp, Artificial Sequence
  Description of Artificial Sequence: Synthetic polynucleotide
  modified_base (89)..(94): a, c, t, g, unknown or other
acttttaacaacaacattacagttggaggctcatcgttcctattccccccccccccccccccccaggcagatgttatcgaggtccgacnnnnnntttaaaattaaaattcttcatcaa

SEQ ID NO: 424 - DNA, 118 bp, Artificial Sequence
  Description of Artificial Sequence: Synthetic polynucleotide
  modified_base (86)..(91): a, c, t, g, unknown or other
ataatttctctaaccttattaccgttggaggctcatcgttcctattcccccccccccccccaggcagatgttatcgaggtccgacnnnnnntctaaataaaataaaaattaattacct

SEQ ID NO: 425 - DNA, 118 bp, Artificial Sequence
  Description of Artificial Sequence: Synthetic polynucleotide
  modified_base (94)..(99): a, c, t, g, unknown or other
aaataacacccctctaaaatgttggaggctcatcgttcctattccccccccccccccccccccccccccaggcagatgttatcgaggtccgacnnnnnntaccacactaactcaaaaa

SEQ ID NO: 426 - DNA, 118 bp, Artificial Sequence
  Description of Artificial Sequence: Synthetic polynucleotide
  modified_base (86)..(91): a, c, t, g, unknown or other
ccccctcttttcacttaagttggaggctcatcgttcctattccccccccccccccccccccaggcagatgttatcgaggtccgacnnnnnntttccacttttactttctctaaacaaa

SEQ ID NO: 427 - DNA, 118 bp, Artificial Sequence
  Description of Artificial Sequence: Synthetic polynucleotide
  modified_base (94)..(99): a, c, t, g, unknown or other
acacaaaaacaaaaacaacaaaagttggaggctcatcgttcctattcccccccccccccccccccccccaggcagatgttatcgaggtccgacnnnnnnaaaccacaaacaaaacaaa

SEQ ID NO: 428 - DNA, 118 bp, Artificial Sequence
  Description of Artificial Sequence: Synthetic polynucleotide
  modified_base (83)..(88): a, c, t, g, unknown or other
acattctctttaaattctcacaagttggaggctcatcgttcctattccccccccccccaggcagatgttatcgaggtccgacnnnnnntttacatccttatattttactataattttt

SEQ ID NO: 429 - DNA, 118 bp, Artificial Sequence
  Description of Artificial Sequence: Synthetic polynucleotide
  modified_base (97)..(102): a, c, t, g, unknown or other
atcctcctccctctccgttggaggctcatcgttcctattcccccccccccccccccccccccccccccccccaggcagatgttatcgaggtccgacnnnnnnaaaactccccctcaaa

SEQ ID NO: 430 - DNA, 118 bp, Artificial Sequence
  Description of Artificial Sequence: Synthetic polynucleotide
  modified_base (92)..(97): a, c, t, g, unknown or other
tctccacactacatctaaaataaccccttgttggaggctcatcgttcctattcccccccccccccccaggcagatgttatcgaggtccgacnnnnnnattaaattacttccaccttct

SEQ ID NO: 431 - DNA, 118 bp, Artificial Sequence
  Description of Artificial Sequence: Synthetic polynucleotide
  modified_base (90)..(95): a, c, t, g, unknown or other
tctttaaaacataaaaaccctaacgttggaggctcatcgttcctattccccccccccccccccccaggcagatgttatcgaggtccgacnnnnnnttaacactcaaatcatattttct

SEQ ID NO: 432 - DNA, 118 bp, Artificial Sequence
  Description of Artificial Sequence: Synthetic polynucleotide
  modified_base (89)..(94): a, c, t, g, unknown or other
acaaaaaccaaaacttaactagttggaggctcatcgttcctattccccccccccccccccccccaggcagatgttatcgaggtccgacnnnnnntaaattcaaactaaatcttttaaa

SEQ ID NO: 433 - DNA, 118 bp, Artificial Sequence
  Description of Artificial Sequence: Synthetic polynucleotide
  modified_base (85)..(90): a, c, t, g, unknown or other
accttacatactcttaccgttggaggctcatcgttcctattcccccccccccccccccccaggcagatgttatcgaggtccgacnnnnnnttcttattactcctcccctttccctata

SEQ ID NO: 434 - DNA, 118 bp, Artificial Sequence
  Description of Artificial Sequence: Synthetic polynucleotide
  modified_base (91)..(96): a, c, t, g, unknown or other
atacaaaactaactacacacagttggaggctcatcgttcctattccccccccccccccccccccccaggcagatgttatcgaggtccgacnnnnnntactctccttccttccactctt

SEQ ID NO: 435 - DNA, 118 bp, Artificial Sequence
  Description of Artificial Sequence: Synthetic polynucleotide
  modified_base (92)..(97): a, c, t, g, unknown or other
ctctacctcttcaaaataaagttggaggctcatcgttcctattccccccccccccccccccccccccaggcagatgttatcgaggtccgacnnnnnnaacctaataaaaaccctaaac

SEQ ID NO: 436 - DNA, 118 bp, Artificial Sequence
  Description of Artificial Sequence: Synthetic polynucleotide
  modified_base (92)..(97): a, c, t, g, unknown or other
atactaaaaacacaactatctaccaaacactcgttggaggctcatcgttcctattccccccccccccaggcagatgttatcgaggtccgacnnnnnntaacctcccccaacacctact

SEQ ID NO: 437 - DNA, 118 bp, Artificial Sequence
  Description of Artificial Sequence: Synthetic polynucleotide
  modified_base (91)..(96): a, c, t, g, unknown or other
tcaaacaacccttaaaataaaaagttggaggctcatcgttcctattccccccccccccccccccccaggcagatgttatcgaggtccgacnnnnnnttacaaatttcccaaataataa

SEQ ID NO: 438 - DNA, 118 bp, Artificial Sequence
  Description of Artificial Sequence: Synthetic polynucleotide
  modified_base (90)..(95): a, c, t, g, unknown or other
ccacctttctaaactacaagttggaggctcatcgttcctattcccccccccccccccccccccccaggcagatgttatcgaggtccgacnnnnnncctaaaactaactctataaacta

SEQ ID NO: 439 - DNA, 118 bp, Artificial Sequence
  Description of Artificial Sequence: Synthetic polynucleotide
  modified_base (91)..(96): a, c, t, g, unknown or other
acattatttactcaaaattactaccagttggaggctcatcgttcctattcccccccccccccccccaggcagatgttatcgaggtccgacnnnnnnttttcaacaaatattctcaaaa

SEQ ID NO: 440 - DNA, 118 bp, Artificial Sequence
  Description of Artificial Sequence: Synthetic polynucleotide
  modified_base (85)..(90): a, c, t, g, unknown or other
attctctttaataaaatttcaaatttcaacagttggaggctcatcgttcctattccccccaggcagatgttatcgaggtccgacnnnnnnaaaaaccaaaatctataaatttctaact

SEQ ID NO: 441 - DNA, 118 bp, Artificial Sequence
  Description of Artificial Sequence: Synthetic polynucleotide
  modified_base (88)..(93): a, c, t, g, unknown or other
catctaaaacttcactttaaatagttggaggctcatcgttcctattcccccccccccccccccaggcagatgttatcgaggtccgacnnnnnntttcttactactaaatatactttaa

SEQ ID NO: 442 - DNA, 118 bp, Artificial Sequence
  Description of Artificial Sequence: Synthetic polynucleotide
  modified_base (95)..(100): a, c, t, g, unknown or other
acccaacacccaaaccgttggaggctcatcgttcctattcccccccccccccccccccccccccccccccaggcagatgttatcgaggtccgacnnnnnnttcattttctcccaaaaa

SEQ ID NO: 443 - DNA, 118 bp, Artificial Sequence
  Description of Artificial Sequence: Synthetic polynucleotide
  modified_base (94)..(99): a, c, t, g, unknown or other
aaaatattaatttttccccaagttggaggctcatcgttcctattcccccccccccccccccccccccccaggcagatgttatcgaggtccgacnnnnnncaaactcctttatccatta

SEQ ID NO: 444 - DNA, 118 bp, Artificial Sequence
  Description of Artificial Sequence: Synthetic polynucleotide
  modified_base (94)..(99): a, c, t, g, unknown or other
acccaaaacaatactaacgttggaggctcatcgttcctattccccccccccccccccccccccccccccaggcagatgttatcgaggtccgacnnnnnnttacaaaacctctcaaaaa

SEQ ID NO: 445 - DNA, 118 bp, Artificial Sequence
  Description of Artificial Sequence: Synthetic polynucleotide
  modified_base (92)..(97): a, c, t, g, unknown or other
aaatacattaaaaactacaccgttggaggctcatcgttcctattcccccccccccccccccccccccaggcagatgttatcgaggtccgacnnnnnntcaacctaaaatctaaaaatc

SEQ ID NO: 446 - DNA, 118 bp, Artificial Sequence
  Description of Artificial Sequence: Synthetic polynucleotide
  modified_base (93)..(98): a, c, t, g, unknown or other
tttatactacaccccattacttcctcagttggaggctcatcgttcctattccccccccccccccccccaggcagatgttatcgaggtccgacnnnnnntactactatttctcaaacct

SEQ ID NO: 447 - DNA, 118 bp, Artificial Sequence
  Description of Artificial Sequence: Synthetic polynucleotide
  modified_base (89)..(94): a, c, t, g, unknown or other
atacaattaaatacttctaactaatcacctagttggaggctcatcgttcctattccccccccccaggcagatgttatcgaggtccgacnnnnnnttttcattcaatacataaatcctt

SEQ ID NO: 448 - DNA, 118 bp, Artificial Sequence
  Description of Artificial Sequence: Synthetic polynucleotide
  modified_base (92)..(97): a, c, t, g, unknown or other
ctcaaaatacctaaaaaccagttggaggctcatcgttcctattccccccccccccccccccccccccaggcagatgttatcgaggtccgacnnnnnnttaaccttcaacaaatactac

SEQ ID NO: 449 - DNA, 118 bp, Artificial Sequence
  Description of Artificial Sequence: Synthetic polynucleotide
  modified_base (91)..(96): a, c, t, g, unknown or other
ttacaaccttaactaactaaagttggaggctcatcgttcctattccccccccccccccccccccccaggcagatgttatcgaggtccgacnnnnnnaaaaatccctataaaaatcaaa

SEQ ID NO: 450 - DNA, 118 bp, Artificial Sequence
  Description of Artificial Sequence: Synthetic polynucleotide
  modified_base (97)..(102): a, c, t, g, unknown or other
actattccaacaccaccgttggaggctcatcgttcctattccccccccccccccccccccccccccccccccaggcagatgttatcgaggtccgacnnnnnnaaaccccaaccccaaa

SEQ ID NO: 451 - DNA, 118 bp, Artificial Sequence
  Description of Artificial Sequence: Synthetic polynucleotide
  modified_base (90)..(95): a, c, t, g, unknown or other
ccaaaacacccaacacaagttggaggctcatcgttcctattccccccccccccccccccccccccaggcagatgttatcgaggtccgacnnnnnnaaaaacctacatatacaaataat

SEQ ID NO: 452 - DNA, 118 bp, Artificial Sequence
  Description of Artificial Sequence: Synthetic polynucleotide
  modified_base (86)..(91): a, c, t, g, unknown or other
aaactccctacactaacaaaatccgttggaggctcatcgttcctattccccccccccccccaggcagatgttatcgaggtccgacnnnnnnacccccaatatcaaccacaatctcttt

SEQ ID NO: 453 - DNA, 118 bp, Artificial Sequence
  Description of Artificial Sequence: Synthetic polynucleotide
  modified_base (94)..(99): a, c, t, g, unknown or other
atactatctacccaaactttcttaaccaaactgttggaggctcatcgttcctattccccccccccccccaggcagatgttatcgaggtccgacnnnnnntcccatccttatcaaaatt

SEQ ID NO: 454 - DNA, 118 bp, Artificial Sequence
  Description of Artificial Sequence: Synthetic polynucleotide
  modified_base (88)..(93): a, c, t, g, unknown or other
caacaaaactaacaactacgttggaggctcatcgttcctattcccccccccccccccccccccaggcagatgttatcgaggtccgacnnnnnnttacaattaacttttcccacaaaat

SEQ ID NO: 455 - DNA, 118 bp, Artificial Sequence
  Description of Artificial Sequence: Synthetic polynucleotide
  modified_base (95)..(100): a, c, t, g, unknown or other
ccaaaaatatactttcccccagttggaggctcatcgttcctattccccccccccccccccccccccccccaggcagatgttatcgaggtccgacnnnnnnaacaatctcaaacacttt

SEQ ID NO: 456 - DNA, 118 bp, Artificial Sequence
  Description of Artificial Sequence: Synthetic polynucleotide
  modified_base (88)..(93): a, c, t, g, unknown or other
acctaacctaaccataaaaacaccgttggaggctcatcgttcctattccccccccccccccccaggcagatgttatcgaggtccgacnnnnnnaatcctatccacctaactcacccat

SEQ ID NO: 457 - DNA, 118 bp, Artificial Sequence
  Description of Artificial Sequence: Synthetic polynucleotide
  modified_base (88)..(93): a, c, t, g, unknown or other
acaatcctaaactaatacccccttacctgttggaggctcatcgttcctattccccccccccccaggcagatgttatcgaggtccgacnnnnnnaaaattaattatttaaatcttcctt

SEQ ID NO: 458 - DNA, 118 bp, Artificial Sequence
  Description of Artificial Sequence: Synthetic polynucleotide
  modified_base (92)..(97): a, c, t, g, unknown or other
attcttaatacatatatttttaattctgttggaggctcatcgttcctattcccccccccccccccccaggcagatgttatcgaggtccgacnnnnnntaactcattaaatcccaaaaa

SEQ ID NO: 459 - DNA, 118 bp, Artificial Sequence
  Description of Artificial Sequence: Synthetic polynucleotide
  modified_base (91)..(96): a, c, t, g, unknown or other
cacatactttttcctaattactaagttggaggctcatcgttcctattcccccccccccccccccccaggcagatgttatcgaggtccgacnnnnnnttccaatacttttattctttct

SEQ ID NO: 460 - DNA, 118 bp, Artificial Sequence
  Description of Artificial Sequence: Synthetic polynucleotide
  modified_base (87)..(92): a, c, t, g, unknown or other
tctatcacccctttctttaactgttggaggctcatcgttcctattcccccccccccccccccaggcagatgttatcgaggtccgacnnnnnncaaatataaaatataatctcctaatt

SEQ ID NO: 461 - DNA, 118 bp, Artificial Sequence
  Description of Artificial Sequence: Synthetic polynucleotide
  modified_base (95)..(100): a, c, t, g, unknown or other
acacaataactctacacaaagttggaggctcatcgttcctattcccccccccccccccccccccccccccaggcagatgttatcgaggtccgacnnnnnnaaatacaaaaccacaacc

SEQ ID NO: 462 - DNA, 118 bp, Artificial Sequence
  Description of Artificial Sequence: Synthetic polynucleotide
  modified_base (89)..(94): a, c, t, g, unknown or other
actcccataaacactcccacgttggaggctcatcgttcctattcccccccccccccccccccccaggcagatgttatcgaggtccgacnnnnnntaaccaaaattcaacaaaaataaa

SEQ ID NO: 463 - DNA, 118 bp, Artificial Sequence
  Description of Artificial Sequence: Synthetic polynucleotide
  modified_base (94)..(99): a, c, t, g, unknown or other
catctacaataatatttatcccgttggaggctcatcgttcctattccccccccccccccccccccccccaggcagatgttatcgaggtccgacnnnnnnaaaaactatacaactccct

SEQ ID NO: 464 - DNA, 118 bp, Artificial Sequence
  Description of Artificial Sequence: Synthetic polynucleotide
  modified_base (97)..(102): a, c, t, g, unknown or other
cttacaactctctaattaaaatgttggaggctcatcgttcctattcccccccccccccccccccccccccccaggcagatgttatcgaggtccgacnnnnnnaaaaacaaccccaacc

SEQ ID NO: 465 - DNA, 118 bp, Artificial Sequence
  Description of Artificial Sequence: Synthetic polynucleotide
  modified_base (93)..(98): a, c, t, g, unknown or other
tcttcttccattttaaaaacaacacgttggaggctcatcgttcctattccccccccccccccccccccaggcagatgttatcgaggtccgacnnnnnnttacaattcttacacatcat

SEQ ID NO: 466 - DNA, 118 bp, Artificial Sequence
  Description of Artificial Sequence: Synthetic polynucleotide
  modified_base (91)..(96): a, c, t, g, unknown or other
caaatatctttcattaaaacataagttggaggctcatcgttcctattcccccccccccccccccccaggcagatgttatcgaggtccgacnnnnnnaaaaacaattcctaaataccct

SEQ ID NO: 467 - DNA, 118 bp, Artificial Sequence
  Description of Artificial Sequence: Synthetic polynucleotide
  modified_base (94)..(99): a, c, t, g, unknown or other
actcctctaaaacaaacctccatctccgttggaggctcatcgttcctattcccccccccccccccccccaggcagatgttatcgaggtccgacnnnnnnacaaaataccttccctacc

SEQ ID NO: 468 - DNA, 118 bp, Artificial Sequence
  Description of Artificial Sequence: Synthetic polynucleotide
  modified_base (92)..(97): a, c, t, g, unknown or other
ctatccaaatccccataaaacgttggaggctcatcgttcctattcccccccccccccccccccccccaggcagatgttatcgaggtccgacnnnnnnaacttcctcctccaccaactt

SEQ ID NO: 469 - DNA, 118 bp, Artificial Sequence
  Description of Artificial Sequence: Synthetic polynucleotide
  modified_base (95)..(100): a, c, t, g, unknown or other
aaaccaacttccctcaaaaagttggaggctcatcgttcctattcccccccccccccccccccccccccccaggcagatgttatcgaggtccgacnnnnnnacctaaaacctttcactt

SEQ ID NO: 470 - DNA, 118 bp, Artificial Sequence
  Description of Artificial Sequence: Synthetic polynucleotide
  modified_base (89)..(94): a, c, t, g, unknown or other
tccctaacaatcaatcctcagttggaggctcatcgttcctattcccccccccccccccccccccaggcagatgttatcgaggtccgacnnnnnnaaaaataactataaaactcaaaat

SEQ ID NO: 471 - DNA, 118 bp, Artificial Sequence
  Description of Artificial Sequence: Synthetic polynucleotide
  modified_base (91)..(96): a, c, t, g, unknown or other
ccacaaaaacacaactactgttggaggctcatcgttcctattccccccccccccccccccccccccaggcagatgttatcgaggtccgacnnnnnntatctaactctatcttttcctt

SEQ ID NO: 472 - DNA, 118 bp, Artificial Sequence
  Description of Artificial Sequence: Synthetic polynucleotide
  modified_base (90)..(95): a, c, t, g, unknown or other
tccttcctttaaaactaatttaaagttggaggctcatcgttcctattccccccccccccccccccaggcagatgttatcgaggtccgacnnnnnnctctattaaaaactatttcctat

SEQ ID NO: 473 - DNA, 118 bp, Artificial Sequence
  Description of Artificial Sequence: Synthetic polynucleotide
  modified_base (95)..(100): a, c, t, g, unknown or other
tcaccaaacaacaaccacctctaaaattcctgttggaggctcatcgttcctattccccccccccccccccaggcagatgttatcgaggtccgacnnnnnntccccataaaaatacctc

SEQ ID NO: 474 - DNA, 118 bp, Artificial Sequence
  Description of Artificial Sequence: Synthetic polynucleotide
  modified_base (93)..(98): a, c, t, g, unknown or other
accaaaccctctacccgttggaggctcatcgttcctattcccccccccccccccccccccccccccccaggcagatgttatcgaggtccgacnnnnnnaaccccttttacaaaaacca

SEQ ID NO: 475 - DNA, 118 bp, Artificial Sequence
  Description of Artificial Sequence: Synthetic polynucleotide
  modified_base (91)..(96): a, c, t, g, unknown or other
ccttcataaacaacaaaaacgttggaggctcatcgttcctattcccccccccccccccccccccccaggcagatgttatcgaggtccgacnnnnnntcttaaaatttcaaactaaacc

SEQ ID NO: 476 - DNA, 118 bp, Artificial Sequence
  Description of Artificial Sequence: Synthetic polynucleotide
  modified_base (96)..(101): a, c, t, g, unknown or other
atctaaacccaacaacaaaagttggaggctcatcgttcctattccccccccccccccccccccccccccccaggcagatgttatcgaggtccgacnnnnnnaacaaacaaccatcact

SEQ ID NO: 477 - DNA, 118 bp, Artificial Sequence
  Description of Artificial Sequence: Synthetic polynucleotide
  modified_base (93)..(98): a, c, t, g, unknown or other
cccacaccacaaacctcaacctgttggaggctcatcgttcctattcccccccccccccccccccccccaggcagatgttatcgaggtccgacnnnnnnaaaaaccaaaatctcaaaaa

SEQ ID NO: 478 - DNA, 118 bp, Artificial Sequence
  Description of Artificial Sequence: Synthetic polynucleotide
  modified_base (88)..(93): a, c, t, g, unknown or other
acccattatctaacctcaacagttggaggctcatcgttcctattcccccccccccccccccccaggcagatgttatcgaggtccgacnnnnnnactaattctacacttttatataaat

SEQ ID NO: 479 - DNA, 118 bp, Artificial Sequence
  Description of Artificial Sequence: Synthetic polynucleotide
  modified_base (89)..(94): a, c, t, g, unknown or other
ctctaaaaataacaaattacacgttggaggctcatcgttcctattcccccccccccccccccccaggcagatgttatcgaggtccgacnnnnnntttaaaactaaattctataacctt

SEQ ID NO: 480 - DNA, 118 bp, Artificial Sequence
  Description of Artificial Sequence: Synthetic polynucleotide
  modified_base (85)..(90): a, c, t, g, unknown or other
ctctacccacttccctaccgttggaggctcatcgttcctattccccccccccccccccccaggcagatgttatcgaggtccgacnnnnnnaacaaacaaacaaaaacaaaaactaaaa

SEQ ID NO: 481 - DNA, 118 bp, Artificial Sequence
  Description of Artificial Sequence: Synthetic polynucleotide
  modified_base (90)..(95): a, c, t, g, unknown or other
tcaaccacataacaacaatacctacctaaaagttggaggctcatcgttcctattcccccccccccaggcagatgttatcgaggtccgacnnnnnntatccccaaaaacttccttatca

SEQ ID NO: 482 - DNA, 118 bp, Artificial Sequence
  Description of Artificial Sequence: Synthetic polynucleotide
  modified_base (93)..(98): a, c, t, g, unknown or other
ccacttttcttctcaacctgttggaggctcatcgttcctattccccccccccccccccccccccccccaggcagatgttatcgaggtccgacnnnnnnttaccaaaacttactaaacc

SEQ ID NO: 483 - DNA, 118 bp, Artificial Sequence
  Description of Artificial Sequence: Synthetic polynucleotide
  modified_base (93)..(98): a, c, t, g, unknown or other
actctaaaattccaaaaacaaaacttagttggaggctcatcgttcctattccccccccccccccccccaggcagatgttatcgaggtccgacnnnnnnatccccttaaaaactctact

SEQ ID NO: 484 - DNA, 118 bp, Artificial Sequence
  Description of Artificial Sequence: Synthetic polynucleotide
  modified_base (89)..(94): a, c, t, g, unknown or other
acactatactacatactaaaataaactaaatcgttggaggctcatcgttcctattcccccccccaggcagatgttatcgaggtccgacnnnnnnttacttaatattttccttaatctt

SEQ ID NO: 485 - DNA, 118 bp, Artificial Sequence
  Description of Artificial Sequence: Synthetic polynucleotide
  modified_base (93)..(98): a, c, t, g, unknown or other
ttcttcttactatttaaataaccaaaaagttggaggctcatcgttcctattcccccccccccccccccaggcagatgttatcgaggtccgacnnnnnntcttatccacacttaaaatt

SEQ ID NO: 486 - DNA, 118 bp, Artificial Sequence
  Description of Artificial Sequence: Synthetic polynucleotide
  modified_base (90)..(95): a, c, t, g, unknown or other
taaaaatcaacttctaaattaaaagttggaggctcatcgttcctattccccccccccccccccccaggcagatgttatcgaggtccgacnnnnnnaaacaaaacaccccttccctttc

SEQ ID NO: 487 - DNA, 118 bp, Artificial Sequence
  Description of Artificial Sequence: Synthetic polynucleotide
  modified_base (90)..(95): a, c, t, g, unknown or other
attccccaccttcccttactctcatatcatcagttggaggctcatcgttcctattccccccccccaggcagatgttatcgaggtccgacnnnnnnataatattattcctaacctccct

SEQ ID NO: 488 - DNA, 118 bp, Artificial Sequence
  Description of Artificial Sequence: Synthetic polynucleotide
  modified_base (95)..(100): a, c, t, g, unknown or other
ccccaaccacctaaaaagttggaggctcatcgttcctattccccccccccccccccccccccccccccccaggcagatgttatcgaggtccgacnnnnnntctctataacaaacccaa

SEQ ID NO: 489 - DNA, 118 bp, Artificial Sequence
  Description of Artificial Sequence: Synthetic polynucleotide
  modified_base (91)..(96): a, c, t, g, unknown or other
cctcaacaaacacacaagttggaggctcatcgttcctattccccccccccccccccccccccccccaggcagatgttatcgaggtccgacnnnnnnactacctcatattctacaattt

SEQ ID NO: 490 - DNA, 118 bp, Artificial Sequence
  Description of Artificial Sequence: Synthetic polynucleotide
  modified_base (88)..(93): a, c, t, g, unknown or other
cctaatatattctataaacacaaagttggaggctcatcgttcctattccccccccccccccccaggcagatgttatcgaggtccgacnnnnnnaaaatccttccatcttcttaaaatc

SEQ ID NO: 491 - DNA, 118 bp, Artificial Sequence
  Description of Artificial Sequence: Synthetic polynucleotide
  modified_base (81)..(86): a, c, t, g, unknown or other
acatctctcaacatttactatacgttggaggctcatcgttcctattccccccccccaggcagatgttatcgaggtccgacnnnnnnaaaaataattaaatataaaactaatatttact

SEQ ID NO: 492 - DNA, 118 bp, Artificial Sequence
  Description of Artificial Sequence: Synthetic polynucleotide
  modified_base (83)..(88): a, c, t, g, unknown or other
attaaacaataacttatcaaacagttggaggctcatcgttcctattccccccccccccaggcagatgttatcgaggtccgacnnnnnntttcccaacacataccacctccaaatacta

SEQ ID NO: 493 - DNA, 118 bp, Artificial Sequence
  Description of Artificial Sequence: Synthetic polynucleotide
  modified_base (91)..(96): a, c, t, g, unknown or other
atacaaccaactcaatcaattcccaccgttggaggctcatcgttcctattccccccccccccccccaggcagatgttatcgaggtccgacnnnnnntcaaccaccaccctcataccca

SEQ ID NO: 494 - DNA, 118 bp, Artificial Sequence
  Description of Artificial Sequence: Synthetic polynucleotide
  modified_base (92)..(97): a, c, t, g, unknown or other
actttatttctaaatttaaactaacttaaaaagttggaggctcatcgttcctattccccccccccccaggcagatgttatcgaggtccgacnnnnnnaacatctttccaaccctaatt

SEQ ID NO: 495 - DNA, 118 bp, Artificial Sequence
  Description of Artificial Sequence: Synthetic polynucleotide
  modified_base (94)..(99): a, c, t, g, unknown or other
cttctaaaaatcccctttctaaagttggaggctcatcgttcctattcccccccccccccccccccccccaggcagatgttatcgaggtccgacnnnnnnaaaaactcaacctcactaa

SEQ ID NO: 496 - DNA, 118 bp, Artificial Sequence
  Description of Artificial Sequence: Synthetic polynucleotide
  modified_base (93)..(98): a, c, t, g, unknown or other
actttactcattcttaaaccaaacccgttggaggctcatcgttcctattcccccccccccccccccccaggcagatgttatcgaggtccgacnnnnnnacctctaacatatcttatct

SEQ ID NO: 497 - DNA, 118 bp, Artificial Sequence
  Description of Artificial Sequence: Synthetic polynucleotide
  modified_base (93)..(98): a, c, t, g, unknown or other
acctattttaaaaacaaaattactcaaattccgttggaggctcatcgttcctattcccccccccccccaggcagatgttatcgaggtccgacnnnnnnaaaatctctaaataatcccc

SEQ ID NO: 498 - DNA, 118 bp, Artificial Sequence
  Description of Artificial Sequence: Synthetic polynucleotide
  modified_base (90)..(95): a, c, t, g, unknown or other
ctcaacaccacccaacgttggaggctcatcgttcctattccccccccccccccccccccccccccaggcagatgttatcgaggtccgacnnnnnnccctaaacctacaactaacaact

SEQ ID NO: 499 - DNA, 118 bp, Artificial Sequence
  Description of Artificial Sequence: Synthetic polynucleotide
  modified_base (81)..(86): a, c, t, g, unknown or other
aaatcaaaccctacatcaaccgttggaggctcatcgttcctattccccccccccccaggcagatgttatcgaggtccgacnnnnnntacaaccctaataatatctactactataccaa

SEQ ID NO: 500 - DNA, 118 bp, Artificial Sequence
  Description of Artificial Sequence: Synthetic polynucleotide
  modified_base (90)..(95): a, c, t, g, unknown or other
ctaaatttactcaccccaacagttggaggctcatcgttcctattcccccccccccccccccccccaggcagatgttatcgaggtccgacnnnnnntaaaacaatctcttcatattttt

SEQ ID NO: 501 - DNA, 118 bp, Artificial Sequence
  Description of Artificial Sequence: Synthetic polynucleotide
  modified_base (81)..(86): a, c, t, g, unknown or other
acaaacaaaatctatccaaaatctctcccgttggaggctcatcgttcctattccccaggcagatgttatcgaggtccgacnnnnnntacctttcctctttcttctacttccttctctt

SEQ ID NO: 502 - DNA, 118 bp, Artificial Sequence
  Description of Artificial Sequence: Synthetic polynucleotide
  modified_base (95)..(100): a, c, t, g, unknown or other
acctcaccaactactcacattacacagttggaggctcatcgttcctattcccccccccccccccccccccaggcagatgttatcgaggtccgacnnnnnnatcaaaaatcccctccat

SEQ ID NO: 503 - DNA, 118 bp, Artificial Sequence
  Description of Artificial Sequence: Synthetic polynucleotide
  modified_base (86)..(91): a, c, t, g, unknown or other
acttttcccctaaaaactctgttggaggctcatcgttcctattccccccccccccccccccaggcagatgttatcgaggtccgacnnnnnnaaaataaaaataacatttccttatcta

SEQ ID NO: 504 - DNA, 118 bp, Artificial Sequence
  Description of Artificial Sequence: Synthetic polynucleotide
  modified_base (93)..(98): a, c, t, g, unknown or other
actccccaaaaacaaaacacttctctaccttgttggaggctcatcgttcctattccccccccccccccaggcagatgttatcgaggtccgacnnnnnnataccccctaaatatttcct

SEQ ID NO: 505 - DNA, 118 bp, Artificial Sequence
  Description of Artificial Sequence: Synthetic polynucleotide
  modified_base (85)..(90): a, c, t, g, unknown or other
atccttaaatcaaactcccttccctgttggaggctcatcgttcctattccccccccccccaggcagatgttatcgaggtccgacnnnnnnattccccacacccctatttaccaaaaac

SEQ ID NO: 506 - DNA, 118 bp, Artificial Sequence
  Description of Artificial Sequence: Synthetic polynucleotide
  modified_base (90)..(95): a, c, t, g, unknown or other
tctccctactacaataaactctgttggaggctcatcgttcctattccccccccccccccccccccaggcagatgttatcgaggtccgacnnnnnnttacatactcaactaaaaattat

SEQ ID NO: 507 - DNA, 118 bp, Artificial Sequence
  Description of Artificial Sequence: Synthetic polynucleotide
  modified_base (91)..(96): a, c, t, g, unknown or other
ccttaaactccaattaaaatcgttggaggctcatcgttcctattccccccccccccccccccccccaggcagatgttatcgaggtccgacnnnnnnttcacatttcactaaataaaaa

SEQ ID NO: 508 - DNA, 118 bp, Artificial Sequence
  Description of Artificial Sequence: Synthetic polynucleotide
  modified_base (93)..(98): a, c, t, g, unknown or other
taactcaataccacaacccaagttggaggctcatcgttcctattccccccccccccccccccccccccaggcagatgttatcgaggtccgacnnnnnntaaactaaatacccatcaca

SEQ ID NO: 509 - DNA, 118 bp, Artificial Sequence
  Description of Artificial Sequence: Synthetic polynucleotide
  modified_base (93)..(98): a, c, t, g, unknown or other
acacaaaaacaaaaacaacaaaaagttggaggctcatcgttcctattcccccccccccccccccccccaggcagatgttatcgaggtccgacnnnnnnaaaaccacaaacaaaacaaa

SEQ ID NO: 510 - DNA, 118 bp, Artificial Sequence
  Description of Artificial Sequence: Synthetic polynucleotide
  modified_base (85)..(90): a, c, t, g, unknown or other
acccctaaccccaaacactctgttggaggctcatcgttcctattccccccccccccccccaggcagatgttatcgaggtccgacnnnnnnaccaacccaatcttctcacattctaaaa

SEQ ID NO: 511 - DNA, 118 bp, Artificial Sequence
  Description of Artificial Sequence: Synthetic polynucleotide
  modified_base (89)..(94): a, c, t, g, unknown or other
tccccacacttaaccacaataagttggaggctcatcgttcctattcccccccccccccccccccaggcagatgttatcgaggtccgacnnnnnntcaaataaatctaaattttcttac

SEQ ID NO: 512 - DNA, 118 bp, Artificial Sequence
  Description of Artificial Sequence: Synthetic polynucleotide
  modified_base (87)..(92): a, c, t, g, unknown or other
actccctcaacaacccaaccccgttggaggctcatcgttcctattcccccccccccccccccaggcagatgttatcgaggtccgacnnnnnnaaactaaaataaaaactctatataaa

SEQ ID NO: 513 - DNA, 118 bp, Artificial Sequence
  Description of Artificial Sequence: Synthetic polynucleotide
  modified_base (86)..(91): a, c, t, g, unknown or other
acatactcaaaaacaccaatccacgttggaggctcatcgttcctattccccccccccccccaggcagatgttatcgaggtccgacnnnnnntttttattcaccctatttttattataa

SEQ ID NO: 514 - DNA, 118 bp, Artificial Sequence
  Description of Artificial Sequence: Synthetic polynucleotide
  modified_base (94)..(99): a, c, t, g, unknown or other
attctcaaaatacaatcccctaaccaacagttggaggctcatcgttcctattcccccccccccccccccaggcagatgttatcgaggtccgacnnnnnntcctaactcccattccaat

SEQ ID NO: 515 - DNA, 118 bp, Artificial Sequence
  Description of Artificial Sequence: Synthetic polynucleotide
  modified_base (86)..(91): a, c, t, g, unknown or other
attataaaaactcaccaaactgttggaggctcatcgttcctattcccccccccccccccccaggcagatgttatcgaggtccgacnnnnnntaatctatttatttccttaaactaaaa

SEQ ID NO: 516 - DNA, 118 bp, Artificial Sequence
  Description of Artificial Sequence: Synthetic polynucleotide
  modified_base (86)..(91): a, c, t, g, unknown or other
acttttaactacactactttctttgttggaggctcatcgttcctattccccccccccccccaggcagatgttatcgaggtccgacnnnnnnaaaatttaaatttatctataaaaatca

SEQ ID NO: 517 - DNA, 118 bp, Artificial Sequence
  Description of Artificial Sequence: Synthetic polynucleotide
  modified_base (86)..(91): a, c, t, g, unknown or other
acttcctttccactaaataatattcattaaagttggaggctcatcgttcctattcccccccaggcagatgttatcgaggtccgacnnnnnnaccattaattaaattctcacctttaat

SEQ ID NO: 518 - DNA, 118 bp, Artificial Sequence
  Description of Artificial Sequence: Synthetic polynucleotide
  modified_base (95)..(100): a, c, t, g, unknown or other
ccactacaaacctaaaccgttggaggctcatcgttcctattcccccccccccccccccccccccccccccaggcagatgttatcgaggtccgacnnnnnntcctccaacactaaataa

SEQ ID NO: 519 - DNA, 118 bp, Artificial Sequence
  Description of Artificial Sequence: Synthetic polynucleotide
  modified_base (88)..(93): a, c, t, g, unknown or other
ataaataaaaccaaacccctgttggaggctcatcgttcctattccccccccccccccccccccaggcagatgttatcgaggtccgacnnnnnnaaaataataactaaccaaataaaaa

SEQ ID NO: 520 - DNA, 118 bp, Artificial Sequence
  Description of Artificial Sequence: Synthetic polynucleotide
  modified_base (92)..(97): a, c, t, g, unknown or other
aaccaacacaaaatctaataagttggaggctcatcgttcctattcccccccccccccccccccccccaggcagatgttatcgaggtccgacnnnnnntcacttttatcttacaacatt

SEQ ID NO: 521 - DNA, 118 bp, Artificial Sequence
  Description of Artificial Sequence: Synthetic polynucleotide
  modified_base (84)..(89): a, c, t, g, unknown or other
ctcccctccctaactagttggaggctcatcgttcctattccccccccccccccccccccaggcagatgttatcgaggtccgacnnnnnnactcccctcaaaataaaacccaataaaaa

SEQ ID NO: 522 - DNA, 118 bp, Artificial Sequence
  Description of Artificial Sequence: Synthetic polynucleotide
  modified_base (86)..(91): a, c, t, g, unknown or other
atcacacaataattccaaagttggaggctcatcgttcctattcccccccccccccccccccaggcagatgttatcgaggtccgacnnnnnntaaacaactttttattatccattataa

SEQ ID NO: 523 - DNA, 118 bp, Artificial Sequence
  Description of Artificial Sequence: Synthetic polynucleotide
  modified_base (93)..(98): a, c, t, g, unknown or other
acataattattaatatccataccctaactcccgttggaggctcatcgttcctattcccccccccccccaggcagatgttatcgaggtccgacnnnnnntatattcatttccacccata

SEQ ID NO: 524 - DNA, 118 bp, Artificial Sequence
  Description of Artificial Sequence: Synthetic polynucleotide
  modified_base (96)..(101): a, c, t, g, unknown or other
aaaaatccaaaaatacaaaaatgttggaggctcatcgttcctattccccccccccccccccccccccccccaggcagatgttatcgaggtccgacnnnnnnaaacctatcctcccctt

SEQ ID NO: 525 - DNA, 118 bp, Artificial Sequence
  Description of Artificial Sequence: Synthetic polynucleotide
  modified_base (94)..(99): a, c, t, g, unknown or other
ctaaccaaatccccttacaaaacgttggaggctcatcgttcctattcccccccccccccccccccccccaggcagatgttatcgaggtccgacnnnnnnaactaaaacttcctccaaa

SEQ ID NO: 526 - DNA, 118 bp, Artificial Sequence
  Description of Artificial Sequence: Synthetic polynucleotide
  modified_base (87)..(92): a, c, t, g, unknown or other
atttattaattccctactatatactccttaagttggaggctcatcgttcctattccccccccaggcagatgttatcgaggtccgacnnnnnnttatcatcaatctaacaaataactaa

SEQ ID NO: 527 - DNA, 118 bp, Artificial Sequence
  Description of Artificial Sequence: Synthetic polynucleotide
  modified_base (93)..(98): a, c, t, g, unknown or other
aaacacaaactaacaataaaagttggaggctcatcgttcctattccccccccccccccccccccccccaggcagatgttatcgaggtccgacnnnnnnaaaaccaaactcttaaaatc

SEQ ID NO: 528 - DNA, 118 bp, Artificial Sequence
  Description of Artificial Sequence: Synthetic polynucleotide
  modified_base (91)..(96): a, c, t, g, unknown or other
ttctaaaaccacaccttcacctacgttggaggctcatcgttcctattcccccccccccccccccccaggcagatgttatcgaggtccgacnnnnnnaaactccacctaataacttctc

SEQ ID NO: 529 - DNA, 118 bp, Artificial Sequence
  Description of Artificial Sequence: Synthetic polynucleotide
  modified_base (90)..(95): a, c, t, g, unknown or other
ccaccaaaaccactccctattcctctacaagttggaggctcatcgttcctattccccccccccccaggcagatgttatcgaggtccgacnnnnnncactccctccaaaaccctcccca

SEQ ID NO: 530 - DNA, 118 bp, Artificial Sequence
  Description of Artificial Sequence: Synthetic polynucleotide
  modified_base (88)..(93): a, c, t, g, unknown or other
acataaaccaatcctctcgttggaggctcatcgttcctattccccccccccccccccccccccaggcagatgttatcgaggtccgacnnnnnnaaaaacataaatatttcaaatatct

SEQ ID NO: 531 - DNA, 118 bp, Artificial Sequence
  Description of Artificial Sequence: Synthetic polynucleotide
  modified_base (94)..(99): a, c, t, g, unknown or other
tccaactaactactctcccctacccaagttggaggctcatcgttcctattcccccccccccccccccccaggcagatgttatcgaggtccgacnnnnnntaacccaaataaacaactt

SEQ ID NO: 532 - DNA, 118 bp, Artificial Sequence
  Description of Artificial Sequence: Synthetic polynucleotide
  modified_base (84)..(89): a, c, t, g, unknown or other
accctccaaacctacacctcttaatccaacgttggaggctcatcgttcctattccccccaggcagatgttatcgaggtccgacnnnnnnaattaaaacacaattacccaacaacaaac

SEQ ID NO: 533 - DNA, 118 bp, Artificial Sequence
  Description of Artificial Sequence: Synthetic polynucleotide
  modified_base (92)..(97): a, c, t, g, unknown or other
ctaaaataccaaactatcatccgttggaggctcatcgttcctattccccccccccccccccccccccaggcagatgttatcgaggtccgacnnnnnnactttcttctatttccattaa

SEQ ID NO: 534 - DNA, 118 bp, Artificial Sequence
  Description of Artificial Sequence: Synthetic polynucleotide
  modified_base (91)..(96): a, c, t, g, unknown or other
ccttctttttcctcttccgttggaggctcatcgttcctattcccccccccccccccccccccccccaggcagatgttatcgaggtccgacnnnnnntaaatttaaacccttcctaaaa

SEQ ID NO: 535 - DNA, 118 bp, Artificial Sequence
  Description of Artificial Sequence: Synthetic polynucleotide
  modified_base (94)..(99): a, c, t, g, unknown or other
acatccaatacaaacttattataaaacagttggaggctcatcgttcctattccccccccccccccccccaggcagatgttatcgaggtccgacnnnnnntcattaaatttccaccaaa

SEQ ID NO: 536 - DNA, 118 bp, Artificial Sequence
  Description of Artificial Sequence: Synthetic polynucleotide
  modified_base (90)..(95): a, c, t, g, unknown or other
ctaaatcactacctcccgttggaggctcatcgttcctattcccccccccccccccccccccccccaggcagatgttatcgaggtccgacnnnnnnccataaataaaaacctctaaaaa

SEQ ID NO: 537 - DNA, 118 bp, Artificial Sequence
  Description of Artificial Sequence: Synthetic polynucleotide
  modified_base (81)..(86): a, c, t, g, unknown or other
atttctattatttcaaacaaataagttggaggctcatcgttcctattcccccccccaggcagatgttatcgaggtccgacnnnnnnttttaataaaattaacctttacctttctcaat

SEQ ID NO: 538 - DNA, 118 bp, Artificial Sequence
  Description of Artificial Sequence: Synthetic polynucleotide
  modified_base (88)..(93): a, c, t, g, unknown or other
ccaaacctacctcctcatcccccgttggaggctcatcgttcctattcccccccccccccccccaggcagatgttatcgaggtccgacnnnnnntactcaactaacaataataaataaa

SEQ ID NO: 539 - DNA, 118 bp, Artificial Sequence
  Description of Artificial Sequence: Synthetic polynucleotide
  modified_base (93)..(98): a, c, t, g, unknown or other
acatccctaacttactctactctcaccccagttggaggctcatcgttcctattcccccccccccccccaggcagatgttatcgaggtccgacnnnnnnatctccctcaaacacaattt

SEQ ID NO: 540 - DNA, 118 bp, Artificial Sequence
  Description of Artificial Sequence: Synthetic polynucleotide
  modified_base (84)..(89): a, c, t, g, unknown or other
acctcttaccccttaaactcctgttggaggctcatcgttcctattccccccccccccccaggcagatgttatcgaggtccgacnnnnnntttctaaattaaaaattctaaaaaccaaa

SEQ ID NO: 541 - DNA, 118 bp, Artificial Sequence
  Description of Artificial Sequence: Synthetic polynucleotide
  modified_base (96)..(101): a, c, t, g, unknown or other
attccaacaacaaaccctagttggaggctcatcgttcctattcccccccccccccccccccccccccccccaggcagatgttatcgaggtccgacnnnnnnaccctccaaacactaaa

SEQ ID NO: 542 - DNA, 118 bp, Artificial Sequence
  Description of Artificial Sequence: Synthetic polynucleotide
  modified_base (93)..(98): a, c, t, g, unknown or other
tcaaataaatctctacacctttctacctgttggaggctcatcgttcctattcccccccccccccccccaggcagatgttatcgaggtccgacnnnnnntccccttacaaaaacaaaaa

SEQ ID NO: 543 - DNA, 118 bp, Artificial Sequence
  Description of Artificial Sequence: Synthetic polynucleotide
  modified_base (97)..(102): a, c, t, g, unknown or other
ataaaccaaatcaactaccgttggaggctcatcgttcctattccccccccccccccccccccccccccccccaggcagatgttatcgaggtccgacnnnnnnaaaaaccccaaaccat

SEQ ID NO: 544 - DNA, 118 bp, Artificial Sequence
  Description of Artificial Sequence: Synthetic polynucleotide
  modified_base (89)..(94): a, c, t, g, unknown or other
acccctaccacatcataacattcctaataaacgttggaggctcatcgttcctattcccccccccaggcagatgttatcgaggtccgacnnnnnnaaaattaaaaatactcttaacatt

SEQ ID NO: 545 - DNA, 118 bp, Artificial Sequence
  Description of Artificial Sequence: Synthetic polynucleotide
  modified_base (87)..(92): a, c, t, g, unknown or other
actaatactcaataaaaataataacgttggaggctcatcgttcctattccccccccccccccaggcagatgttatcgaggtccgacnnnnnntttaaactataaacacccaattttat

SEQ ID NO: 546 - DNA, 118 bp, Artificial Sequence
  Description of Artificial Sequence: Synthetic polynucleotide
  modified_base (89)..(94): a, c, t, g, unknown or other
acttttcctataaataaacctatttaaccgttggaggctcatcgttcctattccccccccccccaggcagatgttatcgaggtccgacnnnnnntccccaacaaaaactttattataa

SEQ ID NO: 547 - DNA, 118 bp, Artificial Sequence
  Description of Artificial Sequence: Synthetic polynucleotide
  modified_base (92)..(97): a, c, t, g, unknown or other
atacataattcacactcatttattaccaagttggaggctcatcgttcctattcccccccccccccccaggcagatgttatcgaggtccgacnnnnnntaaataaatttcccctcccct

SEQ ID NO: 548 - DNA, 118 bp, Artificial Sequence
  Description of Artificial Sequence: Synthetic polynucleotide
  modified_base (92)..(97): a, c, t, g, unknown or other
aaccaaatacatcctactgttggaggctcatcgttcctattccccccccccccccccccccccccccaggcagatgttatcgaggtccgacnnnnnntaaaccaaattctttacaaaa

SEQ ID NO: 549 - DNA, 118 bp, Artificial Sequence
  Description of Artificial Sequence: Synthetic polynucleotide
  modified_base (84)..(89): a, c, t, g, unknown or other
actacctaactatccccaacaccttcctgttggaggctcatcgttcctattccccccccaggcagatgttatcgaggtccgacnnnnnnaatctacctaaaatcctatccataccccc

SEQ ID NO: 550 - DNA, 118 bp, Artificial Sequence
  Description of Artificial Sequence: Synthetic polynucleotide
  modified_base (93)..(98): a, c, t, g, unknown or other
aaacaccaaacctctaaacgttggaggctcatcgttcctattccccccccccccccccccccccccccaggcagatgttatcgaggtccgacnnnnnntaaaaactctaaccacaact

SEQ ID NO: 551 - DNA, 118 bp, Artificial Sequence
  Description of Artificial Sequence: Synthetic polynucleotide
  modified_base (88)..(93): a, c, t, g, unknown or other
atccctaatctattttcataatacacagttggaggctcatcgttcctattcccccccccccccaggcagatgttatcgaggtccgacnnnnnnttactctaccactatatatatttaa

SEQ ID NO: 552 - DNA, 118 bp, Artificial Sequence
  Description of Artificial Sequence: Synthetic polynucleotide
  modified_base (91)..(96): a, c, t, g, unknown or other
cttcaaataaacacaaaacaagttggaggctcatcgttcctattccccccccccccccccccccccaggcagatgttatcgaggtccgacnnnnnnactcaaaaatcaaaattaaaaa

SEQ ID NO: 553 - DNA, 118 bp, Artificial Sequence
  Description of Artificial Sequence: Synthetic polynucleotide
  modified_base (86)..(91): a, c, t, g, unknown or other
ataaacccaaatatacaataaactccgttggaggctcatcgttcctattccccccccccccaggcagatgttatcgaggtccgacnnnnnnataccaaaaccctaaaatatctaaaaa

SEQ ID NO: 554 - DNA, 118 bp, Artificial Sequence
  Description of Artificial Sequence: Synthetic polynucleotide
  modified_base (91)..(96): a, c, t, g, unknown or other
cctatcccaaataccaacctgttggaggctcatcgttcctattcccccccccccccccccccccccaggcagatgttatcgaggtccgacnnnnnntcccaaactaaaaactacaact

SEQ ID NO: 555 - DNA, 118 bp, Artificial Sequence
  Description of Artificial Sequence: Synthetic polynucleotide
  modified_base (87)..(92): a, c, t, g, unknown or other
acactacaaaatactaactaaacagttggaggctcatcgttcctattcccccccccccccccaggcagatgttatcgaggtccgacnnnnnntttaatactatctcattttaatacct

SEQ ID NO: 556 - DNA, 118 bp, Artificial Sequence
  Description of Artificial Sequence: Synthetic polynucleotide
  modified_base (91)..(96): a, c, t, g, unknown or other
ctcaactcccctccccgttggaggctcatcgttcctattcccccccccccccccccccccccccccaggcagatgttatcgaggtccgacnnnnnnattctcaacttttatacttttt

SEQ ID NO: 557 - DNA, 118 bp, Artificial Sequence
  Description of Artificial Sequence: Synthetic polynucleotide
  modified_base (95)..(100): a, c, t, g, unknown or other
ctaattaaatacaaaatacaaactgttggaggctcatcgttcctattcccccccccccccccccccccccaggcagatgttatcgaggtccgacnnnnnnttttcccaatcttttctc

SEQ ID NO: 558 - DNA, 118 bp, Artificial Sequence
  Description of Artificial Sequence: Synthetic polynucleotide
  modified_base (81)..(86): a, c, t, g, unknown or other
aaaaacaacccctctcctccaaccccgttggaggctcatcgttcctattcccccccaggcagatgttatcgaggtccgacnnnnnnaaaacacaatttaacccataacataaatatta

SEQ ID NO: 559 - DNA, 118 bp, Artificial Sequence
  Description of Artificial Sequence: Synthetic polynucleotide
  modified_base (93)..(98): a, c, t, g, unknown or other
aatatcaaccataaaccctccgttggaggctcatcgttcctattccccccccccccccccccccccccaggcagatgttatcgaggtccgacnnnnnnactttaccaaacaaatacat

SEQ ID NO: 560 - DNA, 118 bp, Artificial Sequence
  Description of Artificial Sequence: Synthetic polynucleotide
  modified_base (90)..(95): a, c, t, g, unknown or other
acaactaaaaataacaaaaactttgttggaggctcatcgttcctattccccccccccccccccccaggcagatgttatcgaggtccgacnnnnnnttttccaactacaataacaacac

SEQ ID NO: 561 - DNA, 118 bp, Artificial Sequence
  Description of Artificial Sequence: Synthetic polynucleotide
  modified_base (91)..(96): a, c, t, g, unknown or other
atcccatcaaaacccagttggaggctcatcgttcctattcccccccccccccccccccccccccccaggcagatgttatcgaggtccgacnnnnnnaacacttttactcctcctaaaa

SEQ ID NO: 562 - DNA, 118 bp, Artificial Sequence
  Description of Artificial Sequence: Synthetic polynucleotide
  modified_base (92)..(97): a, c, t, g, unknown or other
ttctttaaaacaacttactccttcgttggaggctcatcgttcctattccccccccccccccccccccaggcagatgttatcgaggtccgacnnnnnnaaattcaacctaacacacaaa

SEQ ID NO: 563 - DNA, 118 bp, Artificial Sequence
  Description of Artificial Sequence: Synthetic polynucleotide
  modified_base (87)..(92): a, c, t, g, unknown or other
ctaccaaactctccacccccacttccgttggaggctcatcgttcctattcccccccccccccaggcagatgttatcgaggtccgacnnnnnnaaatctccacccacacattcctaaaa

SEQ ID NO: 564 - DNA, 118 bp, Artificial Sequence
  Description of Artificial Sequence: Synthetic polynucleotide
  modified_base (93)..(98): a, c, t, g, unknown or other
actttaaattctaacaaattcctgttggaggctcatcgttcctattccccccccccccccccccccccaggcagatgttatcgaggtccgacnnnnnnacatcccaaaacaaaaatat

SEQ ID NO: 565 - DNA, 118 bp, Artificial Sequence
  Description of Artificial Sequence: Synthetic polynucleotide
  modified_base (93)..(98): a, c, t, g, unknown or other
ctcaaccaccctcctacgttggaggctcatcgttcctattccccccccccccccccccccccccccccaggcagatgttatcgaggtccgacnnnnnnacattaaacaaccatctaaa

SEQ ID NO: 566 - DNA, 118 bp, Artificial Sequence
  Description of Artificial Sequence: Synthetic polynucleotide
  modified_base (90)..(95): a, c, t, g, unknown or other
acttacattatcctcaaatccatcaaaaagttggaggctcatcgttcctattcccccccccccccaggcagatgttatcgaggtccgacnnnnnnttctcatcaccacccacactaaa

SEQ ID NO: 567 - DNA, 118 bp, Artificial Sequence
  Description of Artificial Sequence: Synthetic polynucleotide
  modified_base (97)..(102): a, c, t, g, unknown or other
aaaaatataaatactcccttcaagttggaggctcatcgttcctattccccccccccccccccccccccccccaggcagatgttatcgaggtccgacnnnnnnaaccaaaccctaacac

SEQ ID NO: 568 - DNA, 118 bp, Artificial Sequence
  Description of Artificial Sequence: Synthetic polynucleotide
  modified_base (92)..(97): a, c, t, g, unknown or other
atcccactaaaccactctaactaaccgttggaggctcatcgttcctattccccccccccccccccccaggcagatgttatcgaggtccgacnnnnnntaccaaataatctccacttta

SEQ ID NO: 569 - DNA, 118 bp, Artificial Sequence
  Description of Artificial Sequence: Synthetic polynucleotide
  modified_base (93)..(98): a, c, t, g, unknown or other
cctaaacctctcaactcccgttggaggctcatcgttcctattccccccccccccccccccccccccccaggcagatgttatcgaggtccgacnnnnnnctaacaatctatcccaaaaa

SEQ ID NO: 570 - DNA, 118 bp, Artificial Sequence
  Description of Artificial Sequence: Synthetic polynucleotide
  modified_base (93)..(98): a, c, t, g, unknown or other
atataacaactcctcaaaccttaagttggaggctcatcgttcctattcccccccccccccccccccccaggcagatgttatcgaggtccgacnnnnnnaaaaacttttcctcctaaaa

SEQ ID NO: 571 - DNA, 118 bp, Artificial Sequence
  Description of Artificial Sequence: Synthetic polynucleotide
  modified_base (89)..(94): a, c, t, g, unknown or other
ccctctaacctttactcagttggaggctcatcgttcctattcccccccccccccccccccccccaggcagatgttatcgaggtccgacnnnnnnttcactctactccatccactctaa

SEQ ID NO: 572 - DNA, 118 bp, Artificial Sequence
  Description of Artificial Sequence: Synthetic polynucleotide
  modified_base (92)..(97): a, c, t, g, unknown or other
aaacaccctttaatacaatgttggaggctcatcgttcctattcccccccccccccccccccccccccaggcagatgttatcgaggtccgacnnnnnnaaaaactaacacaatcacaat

SEQ ID NO: 573 - DNA, 118 bp, Artificial Sequence
  Description of Artificial Sequence: Synthetic polynucleotide
  modified_base (88)..(93): a, c, t, g, unknown or other
accaacatcttcaacaacgttggaggctcatcgttcctattccccccccccccccccccccccaggcagatgttatcgaggtccgacnnnnnnaaattaatatcatttcaaaaacaaa

SEQ ID NO: 574 - DNA, 118 bp, Artificial Sequence
  Description of Artificial Sequence: Synthetic polynucleotide
  modified_base (94)..(99): a, c, t, g, unknown or other
ccactctatctcccattaagttggaggctcatcgttcctattcccccccccccccccccccccccccccaggcagatgttatcgaggtccgacnnnnnnaaaaaccttacaaatcctt

SEQ ID NO: 575 - DNA, 118 bp, Artificial Sequence
  Description of Artificial Sequence: Synthetic polynucleotide
  modified_base (83)..(88): a, c, t, g, unknown or other
acacccatctaaatcccaccgttggaggctcatcgttcctattcccccccccccccccaggcagatgttatcgaggtccgacnnnnnntatatcatcaactaacccaatacctattat

SEQ ID NO: 576 - DNA, 118 bp, Artificial Sequence
  Description of Artificial Sequence: Synthetic polynucleotide
  modified_base (92)..(97): a, c, t, g, unknown or other
acaccaaaccacaactaactcaaacactcagttggaggctcatcgttcctattccccccccccccccaggcagatgttatcgaggtccgacnnnnnncctccctctacaccaactaaa

SEQ ID NO: 577 - DNA, 118 bp, Artificial Sequence
  Description of Artificial Sequence: Synthetic polynucleotide
  modified_base (86)..(91): a, c, t, g, unknown or other
attaacacctctcaaactccttaagttggaggctcatcgttcctattccccccccccccccaggcagatgttatcgaggtccgacnnnnnnttcatttcctcctcaattataataact

SEQ ID NO: 578 - DNA, 118 bp, Artificial Sequence
  Description of Artificial Sequence: Synthetic polynucleotide
  modified_base (90)..(95): a, c, t, g, unknown or other
cctccaaaaaccctaatctgttggaggctcatcgttcctattcccccccccccccccccccccccaggcagatgttatcgaggtccgacnnnnnnaaaaactataactacctcattta

SEQ ID NO: 579 - DNA, 118 bp, Artificial Sequence
  Description of Artificial Sequence: Synthetic polynucleotide
  modified_base (93)..(98): a, c, t, g, unknown or other
atcctaaatatcttcctcttccttaatttacagttggaggctcatcgttcctattcccccccccccccaggcagatgttatcgaggtccgacnnnnnnaactaaatctacatttcccc

SEQ ID NO: 580 - DNA, 118 bp, Artificial Sequence
  Description of Artificial Sequence: Synthetic polynucleotide
  modified_base (89)..(94): a, c, t, g, unknown or other
atttctttcttacttacaccaagttggaggctcatcgttcctattcccccccccccccccccccaggcagatgttatcgaggtccgacnnnnnnttataccaatcatcataaatttct

SEQ ID NO: 581 - DNA, 118 bp, Artificial Sequence
  Description of Artificial Sequence: Synthetic polynucleotide
  modified_base (92)..(97): a, c, t, g, unknown or other
accctttaacaaccatcgttggaggctcatcgttcctattcccccccccccccccccccccccccccaggcagatgttatcgaggtccgacnnnnnntcaaacctaaataaacaaaaa

SEQ ID NO: 582 - DNA, 118 bp, Artificial Sequence
  Description of Artificial Sequence: Synthetic polynucleotide
  modified_base (90)..(95): a, c, t, g, unknown or other
ccaacctcactaacaaaactgttggaggctcatcgttcctattccccccccccccccccccccccaggcagatgttatcgaggtccgacnnnnnntcaaactaactttaataaaaact

SEQ ID NO: 583 - DNA, 118 bp, Artificial Sequence
  Description of Artificial Sequence: Synthetic polynucleotide
  modified_base (89)..(94): a, c, t, g, unknown or other
acaaaaccacaaaactcgttggaggctcatcgttcctattccccccccccccccccccccccccaggcagatgttatcgaggtccgacnnnnnnaccttccaaaactaacacaacaaa

SEQ ID NO: 584 - DNA, 118 bp, Artificial Sequence
  Description of Artificial Sequence: Synthetic polynucleotide
  modified_base (88)..(93): a, c, t, g, unknown or other
attctcttcctctcccaatccccaaagttggaggctcatcgttcctattccccccccccccccaggcagatgttatcgaggtccgacnnnnnntaaaataaaaacccccttaatattt

SEQ ID NO: 585 - DNA, 118 bp, Artificial Sequence
  Description of Artificial Sequence: Synthetic polynucleotide
  modified_base (90)..(95): a, c, t, g, unknown or other
actcctacttcaactaaatttccgttggaggctcatcgttcctattcccccccccccccccccccaggcagatgttatcgaggtccgacnnnnnnactattaacctataataaacctt

SEQ ID NO: 586 - DNA, 118 bp, Artificial Sequence
  Description of Artificial Sequence: Synthetic polynucleotide
  modified_base (90)..(95): a, c, t, g, unknown or other
aatcacacaaacctcaagttggaggctcatcgttcctattcccccccccccccccccccccccccaggcagatgttatcgaggtccgacnnnnnnaactaactaaacttaaaatacca

SEQ ID NO: 587 - DNA, 118 bp, Artificial Sequence
  Description of Artificial Sequence: Synthetic polynucleotide
  modified_base (94)..(99): a, c, t, g, unknown or other
taacatcaataaacctaacaaaaccacgttggaggctcatcgttcctattcccccccccccccccccccaggcagatgttatcgaggtccgacnnnnnnttttcccaaccaattaaaa

SEQ ID NO: 588 - DNA, 118 bp, Artificial Sequence
  Description of Artificial Sequence: Synthetic polynucleotide
  modified_base (93)..(98): a, c, t, g, unknown or other
tctacccttaccaaattcccaaaatcctgttggaggctcatcgttcctattcccccccccccccccccaggcagatgttatcgaggtccgacnnnnnntttaaaaaccacaacttcca

SEQ ID NO: 589 - DNA, 118 bp, Artificial Sequence
  Description of Artificial Sequence: Synthetic polynucleotide
  modified_base (92)..(97): a, c, t, g, unknown or other
ctctaaacactttaactcagttggaggctcatcgttcctattcccccccccccccccccccccccccaggcagatgttatcgaggtccgacnnnnnntcccattcaataaccattaaa

SEQ ID NO: 590 - DNA, 118 bp, Artificial Sequence
  Description of Artificial Sequence: Synthetic polynucleotide
  modified_base (89)..(94): a, c, t, g, unknown or other
acattcttcaaaaccaccactaatcgttggaggctcatcgttcctattccccccccccccccccaggcagatgttatcgaggtccgacnnnnnntatacctaacataccaaactaccc

SEQ ID NO: 591 - DNA, 118 bp, Artificial Sequence
  Description of Artificial Sequence: Synthetic polynucleotide
  modified_base (86)..(91): a, c, t, g, unknown or other
atctaaaattttctcaactttagttggaggctcatcgttcctattccccccccccccccccaggcagatgttatcgaggtccgacnnnnnnattataaccttaaataatcactaatct

SEQ ID NO: 592 - DNA, 118 bp, Artificial Sequence
  Description of Artificial Sequence: Synthetic polynucleotide
  modified_base (91)..(96): a, c, t, g, unknown or other
cactaaacccaacaaacagttggaggctcatcgttcctattcccccccccccccccccccccccccaggcagatgttatcgaggtccgacnnnnnntaaaaatacacctaatattcct

SEQ ID NO: 593 - DNA, 118 bp, Artificial Sequence
  Description of Artificial Sequence: Synthetic polynucleotide
  modified_base (93)..(98): a, c, t, g, unknown or other
acaaccaaacttaacccgttggaggctcatcgttcctattccccccccccccccccccccccccccccaggcagatgttatcgaggtccgacnnnnnnatacaaaattcctccaatat

SEQ ID NO: 594 - DNA, 118 bp, Artificial Sequence
  Description of Artificial Sequence: Synthetic polynucleotide
  modified_base (86)..(91): a, c, t, g, unknown or other
atccttaaatttactctccaaaccctccgttggaggctcatcgttcctattccccccccccaggcagatgttatcgaggtccgacnnnnnnaaacaattaataaatatttactaaatt

SEQ ID NO: 595 - DNA, 118 bp, Artificial Sequence
  Description of Artificial Sequence: Synthetic polynucleotide
  modified_base (84)..(89): a, c, t, g, unknown or other
cccttttaataccccaccgttggaggctcatcgttcctattccccccccccccccccccaggcagatgttatcgaggtccgacnnnnnnaaacaaaaactcaactcaaataaataaaa

SEQ ID NO: 596 - DNA, 118 bp, Artificial Sequence
  Description of Artificial Sequence: Synthetic polynucleotide
  modified_base (90)..(95): a, c, t, g, unknown or other
cttctttaaattccaaatacagttggaggctcatcgttcctattcccccccccccccccccccccaggcagatgttatcgaggtccgacnnnnnnttccttttaatactactctaaca

SEQ ID NO: 597 - DNA, 118 bp, Artificial Sequence
  Description of Artificial Sequence: Synthetic polynucleotide
  modified_base (95)..(100): a, c, t, g, unknown or other
ccaacaaaacaatataaaacccagttggaggctcatcgttcctattccccccccccccccccccccccccaggcagatgttatcgaggtccgacnnnnnnaacaaactcaaatcccaa

SEQ ID NO: 598 - DNA, 118 bp, Artificial Sequence
  Description of Artificial Sequence: Synthetic polynucleotide
  modified_base (92)..(97): a, c, t, g, unknown or other
tctctttcctctctctactaacacgttggaggctcatcgttcctattccccccccccccccccccccaggcagatgttatcgaggtccgacnnnnnnttcttcaaaatacaaaacact

SEQ ID NO: 599 - DNA, 118 bp, Artificial Sequence
  Description of Artificial Sequence: Synthetic polynucleotide
  modified_base (92)..(97): a, c, t, g, unknown or other
acccaaaacaaaattcacctccaatcttatccgttggaggctcatcgttcctattccccccccccccaggcagatgttatcgaggtccgacnnnnnntacaaccctacctaccaaatt

SEQ ID NO: 600 - DNA, 118 bp, Artificial Sequence
  Description of Artificial Sequence: Synthetic polynucleotide
  modified_base (92)..(97): a, c, t, g, unknown or other
cacttttctttctaatataactccgttggaggctcatcgttcctattccccccccccccccccccccaggcagatgttatcgaggtccgacnnnnnntaaatttcaaactacacaaaa

SEQ ID NO: 601 - DNA, 118 bp, Artificial Sequence
  Description of Artificial Sequence: Synthetic polynucleotide
  modified_base (97)..(102): a, c, t, g, unknown or other
aaacaccaaacacaactcactcgttggaggctcatcgttcctattcccccccccccccccccccccccccccaggcagatgttatcgaggtccgacnnnnnnttcccacaacactcat

SEQ ID NO: 602 - DNA, 118 bp, Artificial Sequence
  Description of Artificial Sequence: Synthetic polynucleotide
  modified_base (92)..(97): a, c, t, g, unknown or other
actctacctatttacccagttggaggctcatcgttcctattccccccccccccccccccccccccccaggcagatgttatcgaggtccgacnnnnnncaaaataactcttaaacacac

SEQ ID NO: 603 - DNA, 118 bp, Artificial Sequence
  Description of Artificial Sequence: Synthetic polynucleotide
  modified_base (88)..(93): a, c, t, g, unknown or other
taatatcaaaatactaaaaactaccaaaacgttggaggctcatcgttcctattccccccccccaggcagatgttatcgaggtccgacnnnnnntttaatttccctataacctttaaca

SEQ ID NO: 604 - DNA, 118 bp, Artificial Sequence
  Description of Artificial Sequence: Synthetic polynucleotide
  modified_base (95)..(100): a, c, t, g, unknown or other
caacaaattaaaacctacctaaaagttggaggctcatcgttcctattcccccccccccccccccccccccaggcagatgttatcgaggtccgacnnnnnnacttaaaaccatcctact

SEQ ID NO: 605 - DNA, 118 bp, Artificial Sequence
  Description of Artificial Sequence: Synthetic polynucleotide
  modified_base (90)..(95): a, c, t, g, unknown or other
cctaaataataacttttcaccgttggaggctcatcgttcctattcccccccccccccccccccccaggcagatgttatcgaggtccgacnnnnnnaaaattccaattaaaaataccca

SEQ ID NO: 606 - DNA, 118 bp, Artificial Sequence
  Description of Artificial Sequence: Synthetic polynucleotide
  modified_base (94)..(99): a, c, t, g, unknown or other
caaataataaaatcaaaactacacgttggaggctcatcgttcctattccccccccccccccccccccccaggcagatgttatcgaggtccgacnnnnnnaaaaactcctcctttaaac

SEQ ID NO: 607 - DNA, 118 bp, Artificial Sequence
  Description of Artificial Sequence: Synthetic polynucleotide
  modified_base (90)..(95): a, c, t, g, unknown or other
cttccaccaaaataatccgttggaggctcatcgttcctattccccccccccccccccccccccccaggcagatgttatcgaggtccgacnnnnnnaatcaacttaaataaatctactt

SEQ ID NO: 608 - DNA, 118 bp, Artificial Sequence
  Description of Artificial Sequence: Synthetic polynucleotide
  modified_base (91)..(96): a, c, t, g, unknown or other
acaaactttaatttacaccaagttggaggctcatcgttcctattccccccccccccccccccccccaggcagatgttatcgaggtccgacnnnnnnaacaaaaatcaacaattaaaaa

SEQ ID NO: 609 - DNA, 118 bp, Artificial Sequence
  Description of Artificial Sequence: Synthetic polynucleotide
  modified_base (93)..(98): a, c, t, g, unknown or other
attctaactaccctactccgttggaggctcatcgttcctattccccccccccccccccccccccccccaggcagatgttatcgaggtccgacnnnnnnacaacattcatcttttaaca

SEQ ID NO: 610 - DNA, 118 bp, Artificial Sequence
  Description of Artificial Sequence: Synthetic polynucleotide
  modified_base (89)..(94): a, c, t, g, unknown or other
atccccctcacctcctctatctatcttaagttggaggctcatcgttcctattccccccccccccaggcagatgttatcgaggtccgacnnnnnnacctctctataaacaaaacaaact

SEQ ID NO: 611 - DNA, 118 bp, Artificial Sequence
  Description of Artificial Sequence: Synthetic polynucleotide
  modified_base (86)..(91): a, c, t, g, unknown or other
accccaacattctccctaaaaccctcctgttggaggctcatcgttcctattccccccccccaggcagatgttatcgaggtccgacnnnnnnaaataatttctatttccaataaaaatt

SEQ ID NO: 612 - DNA, 118 bp, Artificial Sequence
  Description of Artificial Sequence: Synthetic polynucleotide
  modified_base (97)..(102): a, c, t, g, unknown or other
attacccaaaaacacccgttggaggctcatcgttcctattccccccccccccccccccccccccccccccccaggcagatgttatcgaggtccgacnnnnnnaaaaacaactaccccc

SEQ ID NO: 613 - DNA, 118 bp, Artificial Sequence
  Description of Artificial Sequence: Synthetic polynucleotide
  modified_base (93)..(98): a, c, t, g, unknown or other
cccaaaaccaaaatatctaaatgttggaggctcatcgttcctattcccccccccccccccccccccccaggcagatgttatcgaggtccgacnnnnnnttaattactttcccttcaaa

SEQ ID NO: 614 - DNA, 118 bp, Artificial Sequence
  Description of Artificial Sequence: Synthetic polynucleotide
  modified_base (94)..(99): a, c, t, g, unknown or other
cacttattaaaactactaattcctgttggaggctcatcgttcctattccccccccccccccccccccccaggcagatgttatcgaggtccgacnnnnnnttaactctttccatacact

SEQ ID NO: 615 - DNA, 118 bp, Artificial Sequence
  Description of Artificial Sequence: Synthetic polynucleotide
  modified_base (90)..(95): a, c, t, g, unknown or other
acaaaaccacaaaccacatttccgttggaggctcatcgttcctattcccccccccccccccccccaggcagatgttatcgaggtccgacnnnnnnacctccctatctttaataaaaat

SEQ ID NO: 616 - DNA, 118 bp, Artificial Sequence
  Description of Artificial Sequence: Synthetic polynucleotide
  modified_base (96)..(101): a, c, t, g, unknown or other
actccttccataacccgttggaggctcatcgttcctattccccccccccccccccccccccccccccccccaggcagatgttatcgaggtccgacnnnnnnaccacttcctttttcac

SEQ ID NO: 617 - DNA, 118 bp, Artificial Sequence
  Description of Artificial Sequence: Synthetic polynucleotide
  modified_base (89)..(94): a, c, t, g, unknown or other
atacaaccaatccaacaaccaattccaaaagttggaggctcatcgttcctattcccccccccccaggcagatgttatcgaggtccgacnnnnnntattccctaactcctccctacaaa

SEQ ID NO: 618 - DNA, 118 bp, Artificial Sequence
  Description of Artificial Sequence: Synthetic polynucleotide
  modified_base (89)..(94): a, c, t, g, unknown or other
acctaaattaaactaaattatcaacgttggaggctcatcgttcctattccccccccccccccccaggcagatgttatcgaggtccgacnnnnnnaacttcattctcaatatttatttt

SEQ ID NO: 619 - DNA, 118 bp, Artificial Sequence
  Description of Artificial Sequence: Synthetic polynucleotide
  modified_base (84)..(89): a, c, t, g, unknown or other
atacattcccaaacccaccttgttggaggctcatcgttcctattcccccccccccccccaggcagatgttatcgaggtccgacnnnnnnacccttatcctaaattccctatataatat

SEQ ID NO: 620 - DNA, 118 bp, Artificial Sequence
  Description of Artificial Sequence: Synthetic polynucleotide
  modified_base (85)..(90): a, c, t, g, unknown or other
atcctccactcctaatttttccatccaaactgttggaggctcatcgttcctattccccccaggcagatgttatcgaggtccgacnnnnnntatccaaaacactaccaaccaaactaat

SEQ ID NO: 621 - DNA, 118 bp, Artificial Sequence
  Description of Artificial Sequence: Synthetic polynucleotide
  modified_base (97)..(102): a, c, t, g, unknown or other
aaaatactccaactcccgttggaggctcatcgttcctattccccccccccccccccccccccccccccccccaggcagatgttatcgaggtccgacnnnnnnacaaaacaaccccatt

SEQ ID NO: 622 - DNA, 118 bp, Artificial Sequence
  Description of Artificial Sequence: Synthetic polynucleotide
  modified_base (90)..(95): a, c, t, g, unknown or other
caactaattaatattcaacccgttggaggctcatcgttcctattcccccccccccccccccccccaggcagatgttatcgaggtccgacnnnnnntctaaatacaaaactctctataa

SEQ ID NO: 623 - DNA, 118 bp, Artificial Sequence
  Description of Artificial Sequence: Synthetic polynucleotide
  modified_base (89)..(94): a, c, t, g, unknown or other
cccccacccccaatctttcttctcctagttggaggctcatcgttcctattccccccccccccccaggcagatgttatcgaggtccgacnnnnnntttaaatcccttctacttaacatt

SEQ ID NO: 624 - DNA, 118 bp, Artificial Sequence
  Description of Artificial Sequence: Synthetic polynucleotide
  modified_base (97)..(102): a, c, t, g, unknown or other
ttccattctaaataacaacaacgttggaggctcatcgttcctattcccccccccccccccccccccccccccaggcagatgttatcgaggtccgacnnnnnnaaaaaccccctcccaa

SEQ ID NO: 625 - DNA, 118 bp, Artificial Sequence
  Description of Artificial Sequence: Synthetic polynucleotide
  modified_base (92)..(97): a, c, t, g, unknown or other
aaaaaccacaaacctacgttggaggctcatcgttcctattcccccccccccccccccccccccccccaggcagatgttatcgaggtccgacnnnnnnaaaacctaaaatactaacaac

SEQ ID NO: 626 - DNA, 118 bp, Artificial Sequence
  Description of Artificial Sequence: Synthetic polynucleotide
  modified_base (91)..(96): a, c, t, g, unknown or other
accccctcccttcaacaactgttggaggctcatcgttcctattcccccccccccccccccccccccaggcagatgttatcgaggtccgacnnnnnnacacaaatatttattccaaaaa

SEQ ID NO: 627 - DNA, 118 bp, Artificial Sequence
  Description of Artificial Sequence: Synthetic polynucleotide
  modified_base (92)..(97): a, c, t, g, unknown or other
ataaataaaaatttcaacacctcccccaaaccgttggaggctcatcgttcctattccccccccccccaggcagatgttatcgaggtccgacnnnnnnaaaattctctacaatcaaaaa

SEQ ID NO: 628 - DNA, 118 bp, Artificial Sequence
  Description of Artificial Sequence: Synthetic polynucleotide
  modified_base (97)..(102): a, c, t, g, unknown or other
actacctcctcccaatacgttggaggctcatcgttcctattcccccccccccccccccccccccccccccccaggcagatgttatcgaggtccgacnnnnnnattctccctacctcca

SEQ ID NO: 629 - DNA, 118 bp, Artificial Sequence
  Description of Artificial Sequence: Synthetic polynucleotide
  modified_base (82)..(87): a, c, t, g, unknown or other
atttactctaataaatcaaaaacagttggaggctcatcgttcctattccccccccccaggcagatgttatcgaggtccgacnnnnnnataaataaatttacatatctttttcctttta

SEQ ID NO: 630 - DNA, 118 bp, Artificial Sequence
  Description of Artificial Sequence: Synthetic polynucleotide
  modified_base (89)..(94): a, c, t, g, unknown or other
acacactatcacaataaaaaccacctaaatcgttggaggctcatcgttcctattccccccccccaggcagatgttatcgaggtccgacnnnnnntccttaactatctattctattttt

SEQ ID NO: 631 - DNA, 118 bp, Artificial Sequence
  Description of Artificial Sequence: Synthetic polynucleotide
  modified_base (95)..(100): a, c, t, g, unknown or other
caaaaactaaaccctaccctaacagttggaggctcatcgttcctattcccccccccccccccccccccccaggcagatgttatcgaggtccgacnnnnnnaccaacctaaaacctaac

SEQ ID NO: 632 - DNA, 118 bp, Artificial Sequence
  Description of Artificial Sequence: Synthetic polynucleotide
  modified_base (87)..(92): a, c, t, g, unknown or other
cccctaaaatatcatcaccaaaacgttggaggctcatcgttcctattcccccccccccccccaggcagatgttatcgaggtccgacnnnnnnatccaaccctaactaaatcctttaaa

SEQ ID NO: 633 - DNA, 118 bp, Artificial Sequence
  Description of Artificial Sequence: Synthetic polynucleotide
  modified_base (92)..(97): a, c, t, g, unknown or other
tactaaataactaaactaatcctaaaagttggaggctcatcgttcctattcccccccccccccccccaggcagatgttatcgaggtccgacnnnnnnaacttcaaaaactactaaaaa

SEQ ID NO: 634 - DNA, 118 bp, Artificial Sequence
  Description of Artificial Sequence: Synthetic polynucleotide
  modified_base (97)..(102): a, c, t, g, unknown or other
actcaatctcccttttactttgttggaggctcatcgttcctattccccccccccccccccccccccccccccaggcagatgttatcgaggtccgacnnnnnnaacaacatcacctccc

SEQ ID NO: 635 - DNA, 118 bp, Artificial Sequence
  Description of Artificial Sequence: Synthetic polynucleotide
  modified_base (89)..(94): a, c, t, g, unknown or other
aaacccctcccccaatcctatactcgttggaggctcatcgttcctattccccccccccccccccaggcagatgttatcgaggtccgacnnnnnnataccctccaaactaaaatataac

SEQ ID NO: 636 - DNA, 118 bp, Artificial Sequence
  Description of Artificial Sequence: Synthetic polynucleotide
  modified_base (93)..(98): a, c, t, g, unknown or other
accccatccaaacctagttggaggctcatcgttcctattcccccccccccccccccccccccccccccaggcagatgttatcgaggtccgacnnnnnntcattttcattacaccatat

SEQ ID NO: 637 - DNA, 118 bp, Artificial Sequence
  Description of Artificial Sequence: Synthetic polynucleotide
  modified_base (87)..(92): a, c, t, g, unknown or other
acatatctaaacatctacctcagttggaggctcatcgttcctattcccccccccccccccccaggcagatgttatcgaggtccgacnnnnnnttcctaaatttataacttttataaaa

SEQ ID NO: 638 - DNA, 118 bp, Artificial Sequence
  Description of Artificial Sequence: Synthetic polynucleotide
  modified_base (89)..(94): a, c, t, g, unknown or other
acatctatttaactatacacatcaaccccgttggaggctcatcgttcctattccccccccccccaggcagatgttatcgaggtccgacnnnnnnataattttaaattttcctcaatcc

SEQ ID NO: 639 - DNA, 118 bp, Artificial Sequence
  Description of Artificial Sequence: Synthetic polynucleotide
  modified_base (87)..(92): a, c, t, g, unknown or other
attctaaatcaacaatcacctaatcattccgttggaggctcatcgttcctattcccccccccaggcagatgttatcgaggtccgacnnnnnntttaatataacatacaataaccctaa

SEQ ID NO: 640 - DNA, 118 bp, Artificial Sequence
  Description of Artificial Sequence: Synthetic polynucleotide
  modified_base (94)..(99): a, c, t, g, unknown or other
ctctaaaaacttaatatcacaagttggaggctcatcgttcctattccccccccccccccccccccccccaggcagatgttatcgaggtccgacnnnnnnaaacctcaatcaaaaacac

SEQ ID NO: 641 - DNA, 118 bp, Artificial Sequence
  Description of Artificial Sequence: Synthetic polynucleotide
  modified_base (97)..(102): a, c, t, g, unknown or other
atcctcactaaaaactaaacacagttggaggctcatcgttcctattccccccccccccccccccccccccccaggcagatgttatcgaggtccgacnnnnnnaaaccttctccaaacc

SEQ ID NO: 642 - DNA, 118 bp, Artificial Sequence
  Description of Artificial Sequence: Synthetic polynucleotide
  modified_base (92)..(97): a, c, t, g, unknown or other
aaaaccctccctcaatacgttggaggctcatcgttcctattccccccccccccccccccccccccccaggcagatgttatcgaggtccgacnnnnnnatacataaacttaacccaaaa

SEQ ID NO: 643 - DNA, 118 bp, Artificial Sequence
  Description of Artificial Sequence: Synthetic polynucleotide
  modified_base (86)..(91): a, c, t, g, unknown or other
tcccatcctccctaaatcccaatcgttggaggctcatcgttcctattccccccccccccccaggcagatgttatcgaggtccgacnnnnnnatttccctaactacttcctcccctcta

SEQ ID NO: 644 - DNA, 118 bp, Artificial Sequence
  Description of Artificial Sequence: Synthetic polynucleotide
  modified_base (94)..(99): a, c, t, g, unknown or other
acaaacacctacacctccctaatccccaaaagttggaggctcatcgttcctattcccccccccccccccaggcagatgttatcgaggtccgacnnnnnntatccctcctatcaaaaat

SEQ ID NO: 645 - DNA, 118 bp, Artificial Sequence
  Description of Artificial Sequence: Synthetic polynucleotide
  modified_base (85)..(90): a, c, t, g, unknown or other
atatttcctccaaatattttaatttttgttggaggctcatcgttcctattccccccccccaggcagatgttatcgaggtccgacnnnnnnttcactttaataaacatctatttacatt

SEQ ID NO: 646 - DNA, 118 bp, Artificial Sequence
  Description of Artificial Sequence: Synthetic polynucleotide
  modified_base (89)..(94): a, c, t, g, unknown or other
catcttaaaataaaaacaatccgttggaggctcatcgttcctattcccccccccccccccccccaggcagatgttatcgaggtccgacnnnnnnaaacataacttctaaaattaaaaa

SEQ ID NO: 647 - DNA, 118 bp, Artificial Sequence
  Description of Artificial Sequence: Synthetic polynucleotide
  modified_base (93)..(98): a, c, t, g, unknown or other
aaactctaccaacatccgttggaggctcatcgttcctattccccccccccccccccccccccccccccaggcagatgttatcgaggtccgacnnnnnntcactcctttcctataatta

SEQ ID NO: 648 - DNA, 118 bp, Artificial Sequence
  Description of Artificial Sequence: Synthetic polynucleotide
  modified_base (86)..(91): a, c, t, g, unknown or other
atctatactttcattactaataccaccctaccgttggaggctcatcgttcctattccccccaggcagatgttatcgaggtccgacnnnnnnttaaacaaatctatacatctccctaaa

SEQ ID NO: 649 - DNA, 118 bp, Artificial Sequence
  Description of Artificial Sequence: Synthetic polynucleotide
  modified_base (88)..(93): a, c, t, g, unknown or other
acccacaaactattttccaagttggaggctcatcgttcctattccccccccccccccccccccaggcagatgttatcgaggtccgacnnnnnnaaccataaaaataatttataatcaa

SEQ ID NO: 650 - DNA, 118 bp, Artificial Sequence
  Description of Artificial Sequence: Synthetic polynucleotide
  modified_base (87)..(92): a, c, t, g, unknown or other
atataactcacaaccccttcctacccgttggaggctcatcgttcctattcccccccccccccaggcagatgttatcgaggtccgacnnnnnnatcatcacacattacttttatttcat

SEQ ID NO: 651 - DNA, 118 bp, Artificial Sequence
  Description of Artificial Sequence: Synthetic polynucleotide
  modified_base (89)..(94): a, c, t, g, unknown or other
acaccaaaacaaacctctctcacaagttggaggctcatcgttcctattccccccccccccccccaggcagatgttatcgaggtccgacnnnnnntaaatccctacacactcctaccct

SEQ ID NO: 652 - DNA, 118 bp, Artificial Sequence
  Description of Artificial Sequence: Synthetic polynucleotide
  modified_base (91)..(96): a, c, t, g, unknown or other
cttaccatctaatctctccaaagttggaggctcatcgttcctattcccccccccccccccccccccaggcagatgttatcgaggtccgacnnnnnnaaaaactactctacaaatccaa

SEQ ID NO: 653 - DNA, 118 bp, Artificial Sequence
  Description of Artificial Sequence: Synthetic polynucleotide
  modified_base (93)..(98): a, c, t, g, unknown or other
acctaacatctacttaactcgttggaggctcatcgttcctattcccccccccccccccccccccccccaggcagatgttatcgaggtccgacnnnnnncccctaaaaacaatatacca

SEQ ID NO: 654 - DNA, 118 bp, Artificial Sequence
  Description of Artificial Sequence: Synthetic polynucleotide
  modified_base (96)..(101): a, c, t, g, unknown or other
ccctaattaaataatacttaaatccgttggaggctcatcgttcctattcccccccccccccccccccccccaggcagatgttatcgaggtccgacnnnnnnacaaaaacaaaaacccc

SEQ ID NO: 655 - DNA, 118 bp, Artificial Sequence
  Description of Artificial Sequence: Synthetic polynucleotide
  modified_base (94)..(99): a, c, t, g, unknown or other
aaccaaccaaaactaaaagttggaggctcatcgttcctattccccccccccccccccccccccccccccaggcagatgttatcgaggtccgacnnnnnnaaaccctcaaaattacact

SEQ ID NO: 656 - DNA, 118 bp, Artificial Sequence
  Description of Artificial Sequence: Synthetic polynucleotide
  modified_base (92)..(97): a, c, t, g, unknown or other
aaaactctcaaaacttaaaaagttggaggctcatcgttcctattcccccccccccccccccccccccaggcagatgttatcgaggtccgacnnnnnnaaaacataaaaacaactatca

SEQ ID NO: 657 - DNA, 118 bp, Artificial Sequence
  Description of Artificial Sequence: Synthetic polynucleotide
  modified_base (90)..(95): a, c, t, g, unknown or other
acaaataccaaaaataaatttctcatcagttggaggctcatcgttcctattccccccccccccccaggcagatgttatcgaggtccgacnnnnnnactttaaaataaacctaccaaat

SEQ ID NO: 658 - DNA, 118 bp, Artificial Sequence
  Description of Artificial Sequence: Synthetic polynucleotide
  modified_base (91)..(96): a, c, t, g, unknown or other
ttaataaaatacaaacaaacacaagttggaggctcatcgttcctattcccccccccccccccccccaggcagatgttatcgaggtccgacnnnnnnaaaaaccatccaaaattatctt

SEQ ID NO: 659 - DNA, 118 bp, Artificial Sequence
  Description of Artificial Sequence: Synthetic polynucleotide
  modified_base (92)..(97): a, c, t, g, unknown or other
atttcttctcccctctgttggaggctcatcgttcctattccccccccccccccccccccccccccccaggcagatgttatcgaggtccgacnnnnnntttcaaaaatacctaaaaact

SEQ ID NO: 660 - DNA, 118 bp, Artificial Sequence
  Description of Artificial Sequence: Synthetic polynucleotide
  modified_base (95)..(100): a, c, t, g, unknown or other
acaccaaaacaaccacatgttggaggctcatcgttcctattcccccccccccccccccccccccccccccaggcagatgttatcgaggtccgacnnnnnnacccctactaacaaacaa

SEQ ID NO: 661 - DNA, 118 bp, Artificial Sequence
  Description of Artificial Sequence: Synthetic polynucleotide
  modified_base (93)..(98): a, c, t, g, unknown or other
caatttcttaccaaaatcctaatgttggaggctcatcgttcctattccccccccccccccccccccccaggcagatgttatcgaggtccgacnnnnnnaaaaactacactacttccta

SEQ ID NO: 662 - DNA, 118 bp, Artificial Sequence
  Description of Artificial Sequence: Synthetic polynucleotide
  modified_base (90)..(95): a, c, t, g, unknown or other
cccccaactaaatcctcccaatcctgttggaggctcatcgttcctattcccccccccccccccccaggcagatgttatcgaggtccgacnnnnnntcatcctaaaaataaatatacac

SEQ ID NO: 663 - DNA, 118 bp, Artificial Sequence
  Description of Artificial Sequence: Synthetic polynucleotide
  modified_base (89)..(94): a, c, t, g, unknown or other
cccttaaatataacctacaacgttggaggctcatcgttcctattccccccccccccccccccccaggcagatgttatcgaggtccgacnnnnnntctttttctatattaaaacaaaaa

SEQ ID NO: 664 - DNA, 118 bp, Artificial Sequence
  Description of Artificial Sequence: Synthetic polynucleotide
  modified_base (89)..(94): a, c, t, g, unknown or other
atcactccttccctacctttcctacctagttggaggctcatcgttcctattcccccccccccccaggcagatgttatcgaggtccgacnnnnnntccataaacattataaataatact

SEQ ID NO: 665 - DNA, 118 bp, Artificial Sequence
  Description of Artificial Sequence: Synthetic polynucleotide
  modified_base (89)..(94): a, c, t, g, unknown or other
atttcattttctttccatataactttgttggaggctcatcgttcctattcccccccccccccccaggcagatgttatcgaggtccgacnnnnnntactaatttaatacacacataaat

SEQ ID NO: 666 - DNA, 118 bp, Artificial Sequence
  Description of Artificial Sequence: Synthetic polynucleotide
  modified_base (91)..(96): a, c, t, g, unknown or other
acaccctatctacactaaataaacacatgttggaggctcatcgttcctattcccccccccccccccaggcagatgttatcgaggtccgacnnnnnnaccctatctacactaaataaac

SEQ ID NO: 667 - DNA, 118 bp, Artificial Sequence
  Description of Artificial Sequence: Synthetic polynucleotide
  modified_base (90)..(95): a, c, t, g, unknown or other
atcccaaataccaaccgttggaggctcatcgttcctattccccccccccccccccccccccccccaggcagatgttatcgaggtccgacnnnnnnaaactaaaaactacaactactaa

SEQ ID NO: 668 - DNA, 118 bp, Artificial Sequence
  Description of Artificial Sequence: Synthetic polynucleotide
  modified_base (94)..(99): a, c, t, g, unknown or other
cactcaaacttatcatacttctagttggaggctcatcgttcctattcccccccccccccccccccccccaggcagatgttatcgaggtccgacnnnnnnaactaaaacaaaaccacct

SEQ ID NO: 669 - DNA, 118 bp, Artificial Sequence
  Description of Artificial Sequence: Synthetic polynucleotide
  modified_base (92)..(97): a, c, t, g, unknown or other
aaataaaatcacaacaaccgttggaggctcatcgttcctattcccccccccccccccccccccccccaggcagatgttatcgaggtccgacnnnnnnaatccaaaaacaaaaacaaaa

SEQ ID NO: 670 - DNA, 118 bp, Artificial Sequence
  Description of Artificial Sequence: Synthetic polynucleotide
  modified_base (91)..(96): a, c, t, g, unknown or other
ctcctctttccctcactgttggaggctcatcgttcctattccccccccccccccccccccccccccaggcagatgttatcgaggtccgacnnnnnntaaccaaaatcctctttcaaaa

SEQ ID NO: 671 - DNA, 118 bp, Artificial Sequence
  Description of Artificial Sequence: Synthetic polynucleotide
  modified_base (90)..(95): a, c, t, g, unknown or other
acctccccaaacacacctcacactgttggaggctcatcgttcctattccccccccccccccccccaggcagatgttatcgaggtccgacnnnnnnttttctaatcttcaaaatcccaa

SEQ ID NO: 672 - DNA, 118 bp, Artificial Sequence
  Description of Artificial Sequence: Synthetic polynucleotide
  modified_base (95)..(100): a, c, t, g, unknown or other
atcccctctcatcttaagttggaggctcatcgttcctattccccccccccccccccccccccccccccccaggcagatgttatcgaggtccgacnnnnnnaccacaatctttctttct

SEQ ID NO: 673 - DNA, 118 bp, Artificial Sequence
  Description of Artificial Sequence: Synthetic polynucleotide
  modified_base (93)..(98): a, c, t, g, unknown or other
caaatacccacaataactacatattgttggaggctcatcgttcctattccccccccccccccccccccaggcagatgttatcgaggtccgacnnnnnnacctactaacaataacaaaa

SEQ ID NO: 674 - DNA, 118 bp, Artificial Sequence
  Description of Artificial Sequence: Synthetic polynucleotide
  modified_base (91)..(96): a, c, t, g, unknown or other
aaaccaaactaaacaaaacgttggaggctcatcgttcctattccccccccccccccccccccccccaggcagatgttatcgaggtccgacnnnnnnacaattattactttcctaaaaa

SEQ ID NO: 675 - DNA, 118 bp, Artificial Sequence
  Description of Artificial Sequence: Synthetic polynucleotide
  modified_base (92)..(97): a, c, t, g, unknown or other
atcccccttcttcaaaagttggaggctcatcgttcctattcccccccccccccccccccccccccccaggcagatgttatcgaggtccgacnnnnnnaaaacctaactaactaaaact

SEQ ID NO: 676 - DNA, 118 bp, Artificial Sequence
  Description of Artificial Sequence: Synthetic polynucleotide
  modified_base (95)..(100): a, c, t, g, unknown or other
ttcacctactcactccgttggaggctcatcgttcctattcccccccccccccccccccccccccccccccaggcagatgttatcgaggtccgacnnnnnntctctacccaactaaaaa

SEQ ID NO: 677 - DNA, 118 bp, Artificial Sequence
  Description of Artificial Sequence: Synthetic polynucleotide
  modified_base (85)..(90): a, c, t, g, unknown or other
tcccattatacctaaactctcctcccgttggaggctcatcgttcctattcccccccccccaggcagatgttatcgaggtccgacnnnnnnacataacattcttcaatacaaacccacc

SEQ ID NO: 678 - DNA, 118 bp, Artificial Sequence
  Description of Artificial Sequence: Synthetic polynucleotide
  modified_base (92)..(97): a, c, t, g, unknown or other
acttttaaatcttctacctttcgttggaggctcatcgttcctattccccccccccccccccccccccaggcagatgttatcgaggtccgacnnnnnnaccataaataaaacacaaaaa

SEQ ID NO: 679 - DNA, 118 bp, Artificial Sequence
  Description of Artificial Sequence: Synthetic polynucleotide
  modified_base (91)..(96): a, c, t, g, unknown or other
accctactctcaactcaccccacttctcgttggaggctcatcgttcctattcccccccccccccccaggcagatgttatcgaggtccgacnnnnnnatcccctcatcaaactcaccca

SEQ ID NO: 680 - DNA, 118 bp, Artificial Sequence
  Description of Artificial Sequence: Synthetic polynucleotide
  modified_base (84)..(89): a, c, t, g, unknown or other
acatcctactaataaaccaaaatcatcacagttggaggctcatcgttcctattccccccaggcagatgttatcgaggtccgacnnnnnntcaaattcttacttctttcaaacccaaaa

SEQ ID NO: 681 - DNA, 118 bp, Artificial Sequence
  Description of Artificial Sequence: Synthetic polynucleotide
  modified_base (96)..(101): a, c, t, g, unknown or other
catcctcctctttataataaaactagttggaggctcatcgttcctattcccccccccccccccccccccccaggcagatgttatcgaggtccgacnnnnnnaaaactaccaaaacacc

SEQ ID NO: 682 - DNA, 118 bp, Artificial Sequence
  Description of Artificial Sequence: Synthetic polynucleotide
  modified_base (91)..(96): a, c, t, g, unknown or other
ataaacacacaatataaaaactagttggaggctcatcgttcctattccccccccccccccccccccaggcagatgttatcgaggtccgacnnnnnnaaaactcaaaaataaaaacaaa

SEQ ID NO: 683 - DNA, 118 bp, Artificial Sequence
  Description of Artificial Sequence: Synthetic polynucleotide
  modified_base (94)..(99): a, c, t, g, unknown or other
cctttctctaaacacttaacaaagttggaggctcatcgttcctattcccccccccccccccccccccccaggcagatgttatcgaggtccgacnnnnnnacaaaaactcctcctaaaa

SEQ ID NO: 684 - DNA, 118 bp, Artificial Sequence
  Description of Artificial Sequence: Synthetic polynucleotide
  modified_base (87)..(92): a, c, t, g, unknown or other
attcctaccttactctaaataactcactagttggaggctcatcgttcctattccccccccccaggcagatgttatcgaggtccgacnnnnnnaaaataaaaataattccttttaattt

SEQ ID NO: 685 - DNA, 118 bp, Artificial Sequence
  Description of Artificial Sequence: Synthetic polynucleotide
  modified_base (89)..(94): a, c, t, g, unknown or other
cccttcctaaaccctagttggaggctcatcgttcctattcccccccccccccccccccccccccaggcagatgttatcgaggtccgacnnnnnntaaaactctaatttatatttccaa

SEQ ID NO: 686 - DNA, 118 bp, Artificial Sequence
  Description of Artificial Sequence: Synthetic polynucleotide
  modified_base (88)..(93): a, c, t, g, unknown or other
acataaaaccttcctttttctcccctctttatgttggaggctcatcgttcctattccccccccaggcagatgttatcgaggtccgacnnnnnntcataataataccaaataaacaaac

SEQ ID NO: 687 - DNA, 118 bp, Artificial Sequence
  Description of Artificial Sequence: Synthetic polynucleotide
  modified_base (85)..(90): a, c, t, g, unknown or other
ccaataacaaaaacaaatccgttggaggctcatcgttcctattcccccccccccccccccaggcagatgttatcgaggtccgacnnnnnnaccccaactttctcctaaactaacaacc

SEQ ID NO: 688 - DNA, 118 bp, Artificial Sequence
  Description of Artificial Sequence: Synthetic polynucleotide
  modified_base (85)..(90): a, c, t, g, unknown or other
ccactacaacccaattcctctaaaaataattgttggaggctcatcgttcctattccccccaggcagatgttatcgaggtccgacnnnnnnttcctctctaaatcctaccaaataaaaa

SEQ ID NO: 689 - DNA, 118 bp, Artificial Sequence
  Description of Artificial Sequence: Synthetic polynucleotide
  modified_base (90)..(95): a, c, t, g, unknown or other
taacaaattttcctcttcactcgttggaggctcatcgttcctattccccccccccccccccccccaggcagatgttatcgaggtccgacnnnnnnttcctctaattctaataacttca

SEQ ID NO: 690 - DNA, 118 bp, Artificial Sequence
  Description of Artificial Sequence: Synthetic polynucleotide
  modified_base (88)..(93): a, c, t, g, unknown or other
ccaacttccctacaaccccaaagttggaggctcatcgttcctattccccccccccccccccccaggcagatgttatcgaggtccgacnnnnnntaacactacaaaaacaaaccctaaa

SEQ ID NO: 691 - DNA, 118 bp, Artificial Sequence
  Description of Artificial Sequence: Synthetic polynucleotide
  modified_base (88)..(93): a, c, t, g, unknown or other
cctcatacattttcctctgttggaggctcatcgttcctattccccccccccccccccccccccaggcagatgttatcgaggtccgacnnnnnnaactcttcctaccttctctatcata

SEQ ID NO: 692 - DNA, 118 bp, Artificial Sequence
  Description of Artificial Sequence: Synthetic polynucleotide
  modified_base (95)..(100): a, c, t, g, unknown or other
acacctacacctccctgttggaggctcatcgttcctattcccccccccccccccccccccccccccccccaggcagatgttatcgaggtccgacnnnnnnaaaacccaaacaaaactt

SEQ ID NO: 693 - DNA, 118 bp, Artificial Sequence
  Description of Artificial Sequence: Synthetic polynucleotide
  modified_base (90)..(95): a, c, t, g, unknown or other
acttattttatttaaaaacaaaatcttactctgttggaggctcatcgttcctattccccccccccaggcagatgttatcgaggtccgacnnnnnntttcctctaattaatttcaaatt

SEQ ID NO: 694 - DNA, 118 bp, Artificial Sequence
  Description of Artificial Sequence: Synthetic polynucleotide
  modified_base (88)..(93): a, c, t, g, unknown or other
acactcactctactccttcttcagttggaggctcatcgttcctattcccccccccccccccccaggcagatgttatcgaggtccgacnnnnnnaaatatttatactcattactaacat

SEQ ID NO: 695 - DNA, 118 bp, Artificial Sequence
  Description of Artificial Sequence: Synthetic polynucleotide
  modified_base (87)..(92): a, c, t, g, unknown or other
acaacatccaaaatatcaccaaaccagttggaggctcatcgttcctattcccccccccccccaggcagatgttatcgaggtccgacnnnnnntttattctctaaccacttaataatat

SEQ ID NO: 696 - DNA, 118 bp, Artificial Sequence
  Description of Artificial Sequence: Synthetic polynucleotide
  modified_base (93)..(98): a, c, t, g, unknown or other
cattaataaaccctaaacactttgttggaggctcatcgttcctattccccccccccccccccccccccaggcagatgttatcgaggtccgacnnnnnnacaaacctatttataacact

SEQ ID NO: 697 - DNA, 118 bp, Artificial Sequence
  Description of Artificial Sequence: Synthetic polynucleotide
  modified_base (95)..(100): a, c, t, g, unknown or other
accactaaaaatcacccccgttggaggctcatcgttcctattccccccccccccccccccccccccccccaggcagatgttatcgaggtccgacnnnnnnaaacctccttaaaaccaa

SEQ ID NO: 698 - DNA, 118 bp, Artificial Sequence
  Description of Artificial Sequence: Synthetic polynucleotide
  modified_base (90)..(95): a, c, t, g, unknown or other
ccttccaactcttcttaaccttaccaccgttggaggctcatcgttcctattccccccccccccccaggcagatgttatcgaggtccgacnnnnnnaaaaataaaaatccacaaaacta

SEQ ID NO: 699 - DNA, 118 bp, Artificial Sequence
  Description of Artificial Sequence: Synthetic polynucleotide
  modified_base (91)..(96): a, c, t, g, unknown or other
caaaataaacaaacaacccccgttggaggctcatcgttcctattccccccccccccccccccccccaggcagatgttatcgaggtccgacnnnnnntaaatattcaacaaactaaact

SEQ ID NO: 700 - DNA, 118 bp, Artificial Sequence
  Description of Artificial Sequence: Synthetic polynucleotide
  modified_base (95)..(100): a, c, t, g, unknown or other
caatttcacttttcttttcctcttgttggaggctcatcgttcctattcccccccccccccccccccccccaggcagatgttatcgaggtccgacnnnnnntcctcccttaactaaaaa

SEQ ID NO: 701 - DNA, 118 bp, Artificial Sequence
  Description of Artificial Sequence: Synthetic polynucleotide
  modified_base (93)..(98): a, c, t, g, unknown or other
atttccaaccaacaccagttggaggctcatcgttcctattccccccccccccccccccccccccccccaggcagatgttatcgaggtccgacnnnnnnaaacaaactcataacaaaaa

SEQ ID NO: 702 - DNA, 118 bp, Artificial Sequence
  Description of Artificial Sequence: Synthetic polynucleotide
  modified_base (85)..(90): a, c, t, g, unknown or other
tacaacaaacctacccttgttggaggctcatcgttcctattcccccccccccccccccccaggcagatgttatcgaggtccgacnnnnnntctaatataaaactaaactctatactat

SEQ ID NO: 703 - DNA, 118 bp, Artificial Sequence
  Description of Artificial Sequence: Synthetic polynucleotide
  modified_base (88)..(93): a, c, t, g, unknown or other
acttcacaacccccaccaaacaaaatgttggaggctcatcgttcctattccccccccccccccaggcagatgttatcgaggtccgacnnnnnntttccttaaactttaaacccaatat

SEQ ID NO: 704 - DNA, 118 bp, Artificial Sequence
  Description of Artificial Sequence: Synthetic polynucleotide
  modified_base (93)..(98): a, c, t, g, unknown or other
ccttttaatcaaactactccgttggaggctcatcgttcctattcccccccccccccccccccccccccaggcagatgttatcgaggtccgacnnnnnnaaactaaactcctacaaaaa

SEQ ID NO: 705 - DNA, 118 bp, Artificial Sequence
  Description of Artificial Sequence: Synthetic polynucleotide
  modified_base (95)..(100): a, c, t, g, unknown or other
attaccctaccaaaactaagttggaggctcatcgttcctattccccccccccccccccccccccccccccaggcagatgttatcgaggtccgacnnnnnnacctcccaaaatactaaa

SEQ ID NO: 706 - DNA, 118 bp, Artificial Sequence
  Description of Artificial Sequence: Synthetic polynucleotide
  modified_base (95)..(100): a, c, t, g, unknown or other
caatacacactttccaactatcagttggaggctcatcgttcctattccccccccccccccccccccccccaggcagatgttatcgaggtccgacnnnnnncttaacctaaaaactccc

SEQ ID NO: 707 - DNA, 118 bp, Artificial Sequence
  Description of Artificial Sequence: Synthetic polynucleotide
  modified_base (89)..(94): a, c, t, g, unknown or other
acttcctacctaactctaactcacacaacaacgttggaggctcatcgttcctattcccccccccaggcagatgttatcgaggtccgacnnnnnntatttccttttaccaacccacacc

SEQ ID NO: 708 - DNA, 118 bp, Artificial Sequence; identical to SEQ ID NO: 593
  Description of Artificial Sequence: Synthetic polynucleotide
  modified_base (93)..(98): a, c, t, g, unknown or other

SEQ ID NO: 709 - DNA, 118 bp, Artificial Sequence
  Description of Artificial Sequence: Synthetic polynucleotide
  modified_base (97)..(102): a, c, t, g, unknown or other
ttaccaactctactcaacgttggaggctcatcgttcctattcccccccccccccccccccccccccccccccaggcagatgttatcgaggtccgacnnnnnnaaaccctcccccaacc

SEQ ID NO: 710 - DNA, 118 bp, Artificial Sequence
  Description of Artificial Sequence: Synthetic polynucleotide
  modified_base (96)..(101): a, c, t, g, unknown or other
cactttaaactaaaactactttttaagttggaggctcatcgttcctattccccccccccccccccccccccaggcagatgttatcgaggtccgacnnnnnnttacaaaacaactccct

SEQ ID NO: 711 - DNA, 118 bp, Artificial Sequence
  Description of Artificial Sequence: Synthetic polynucleotide
  modified_base (94)..(99): a, c, t, g, unknown or other
ccaactcctacactcaaaatgttggaggctcatcgttcctattccccccccccccccccccccccccccaggcagatgttatcgaggtccgacnnnnnntacactacaaatacacacc

SEQ ID NO: 712 - DNA, 118 bp, Artificial Sequence
  Description of Artificial Sequence: Synthetic polynucleotide
  modified_base (91)..(96): a, c, t, g, unknown or other
aaactaacttcaaacaactccgttggaggctcatcgttcctattccccccccccccccccccccccaggcagatgttatcgaggtccgacnnnnnnacaatataaactcaaacaaaaa

SEQ ID NO: 713 - DNA, 118 bp, Artificial Sequence
  Description of Artificial Sequence: Synthetic polynucleotide
  modified_base (92)..(97): a, c, t, g, unknown or other
aaattcatctccaaaaacccaacccgttggaggctcatcgttcctattcccccccccccccccccccaggcagatgttatcgaggtccgacnnnnnnaaaccacaactaaattcctta

SEQ ID NO: 714 - DNA, 118 bp, Artificial Sequence
  Description of Artificial Sequence: Synthetic polynucleotide
  modified_base (95)..(100): a, c, t, g, unknown or other
accatccaccacatacgttggaggctcatcgttcctattcccccccccccccccccccccccccccccccaggcagatgttatcgaggtccgacnnnnnnttccaaaacaactaacaa

SEQ ID NO: 715 - DNA, 118 bp, Artificial Sequence
  Description of Artificial Sequence: Synthetic polynucleotide
  modified_base (89)..(94): a, c, t, g, unknown or other
acaaaacaaaaccacttccccaaaagttggaggctcatcgttcctattccccccccccccccccaggcagatgttatcgaggtccgacnnnnnntttcaataatatctaacacataaa

SEQ ID NO: 716 - DNA, 118 bp, Artificial Sequence
  Description of Artificial Sequence: Synthetic polynucleotide
  modified_base (89)..(94): a, c, t, g, unknown or other
actcccaacctttccaccaaaacctaactagttggaggctcatcgttcctattcccccccccccaggcagatgttatcgaggtccgacnnnnnntccaatattaccaaaaactaaaaa

SEQ ID NO: 717 - DNA, 118 bp, Artificial Sequence
  Description of Artificial Sequence: Synthetic polynucleotide
  modified_base (90)..(95): a, c, t, g, unknown or other
aatcacccttcatcttcaaatgttggaggctcatcgttcctattcccccccccccccccccccccaggcagatgttatcgaggtccgacnnnnnnaatatccataacctcctaataaa

SEQ ID NO: 718 - DNA, 118 bp, Artificial Sequence
  Description of Artificial Sequence: Synthetic polynucleotide
  modified_base (89)..(94): a, c, t, g, unknown or other
attaataaaataacaaactacaaaagttggaggctcatcgttcctattccccccccccccccccaggcagatgttatcgaggtccgacnnnnnnatataccttttacaaatattttct

SEQ ID NO: 719 - DNA, 118 bp, Artificial Sequence
  Description of Artificial Sequence: Synthetic polynucleotide
  modified_base (87)..(92): a, c, t, g, unknown or other
tctacaaaacaccttcccctccccttcagttggaggctcatcgttcctattcccccccccccaggcagatgttatcgaggtccgacnnnnnntcaaatttctctttcaatttctaacc

SEQ ID NO: 720 - DNA, 118 bp, Artificial Sequence
  Description of Artificial Sequence: Synthetic polynucleotide
  modified_base (89)..(94): a, c, t, g, unknown or other
aaactcaaaaccaacctgttggaggctcatcgttcctattccccccccccccccccccccccccaggcagatgttatcgaggtccgacnnnnnnttaaaatacatccttcttaaccta

SEQ ID NO: 721 - DNA, 118 bp, Artificial Sequence
  Description of Artificial Sequence: Synthetic polynucleotide
  modified_base (89)..(94): a, c, t, g, unknown or other
acctccactaaacaaaaccaaacccctaagttggaggctcatcgttcctattccccccccccccaggcagatgttatcgaggtccgacnnnnnnatacaaccattaactataatactt

SEQ ID NO: 722 - DNA, 118 bp, Artificial Sequence
  Description of Artificial Sequence: Synthetic polynucleotide
  modified_base (88)..(93): a, c, t, g, unknown or other
acctcttcccacataacccaaaattaaacttagttggaggctcatcgttcctattccccccccaggcagatgttatcgaggtccgacnnnnnnaaaacaaaataaaaccctaaatttt

SEQ ID NO: 723 - DNA, 118 bp, Artificial Sequence
  Description of Artificial Sequence: Synthetic polynucleotide
  modified_base (91)..(96): a, c, t, g, unknown or other
acactacaaaatactaactaaacactcagttggaggctcatcgttcctattcccccccccccccccaggcagatgttatcgaggtccgacnnnnnnatactatctcattttaatacct

SEQ ID NO: 724 - DNA, 118 bp, Artificial Sequence
  Description of Artificial Sequence: Synthetic polynucleotide
  modified_base (92)..(97): a, c, t, g, unknown or other
acccaactactccacagttggaggctcatcgttcctattccccccccccccccccccccccccccccaggcagatgttatcgaggtccgacnnnnnntttactaaaaacatccaacat

SEQ ID NO: 725 - DNA, 118 bp, Artificial Sequence
  Description of Artificial Sequence: Synthetic polynucleotide
  modified_base (95)..(100): a, c, t, g, unknown or other
cctacccttttatatataaaactgttggaggctcatcgttcctattccccccccccccccccccccccccaggcagatgttatcgaggtccgacnnnnnncaaccttacctttcttct

SEQ ID NO: 726 - DNA, 118 bp, Artificial Sequence
  Description of Artificial Sequence: Synthetic polynucleotide
  modified_base (89)..(94): a, c, t, g, unknown or other
ccacaaacttctatcctagttggaggctcatcgttcctattcccccccccccccccccccccccaggcagatgttatcgaggtccgacnnnnnntctactttaacttaaaatctaaaa

SEQ ID NO: 727 - DNA, 118 bp, Artificial Sequence
  Description of Artificial Sequence: Synthetic polynucleotide
  modified_base (92)..(97): a, c, t, g, unknown or other
ctccaaacttacaacacgttggaggctcatcgttcctattcccccccccccccccccccccccccccaggcagatgttatcgaggtccgacnnnnnnaaaaatcttcctacaaaatac

SEQ ID NO: 728 - DNA, 118 bp, Artificial Sequence
  Description of Artificial Sequence: Synthetic polynucleotide
  modified_base (93)..(98): a, c, t, g, unknown or other
acaaaaatctcctacaaaacgttggaggctcatcgttcctattcccccccccccccccccccccccccaggcagatgttatcgaggtccgacnnnnnnaaaactctacttattcctca

SEQ ID NO: 729 - DNA, 118 bp, Artificial Sequence
  Description of Artificial Sequence: Synthetic polynucleotide
  modified_base (91)..(96): a, c, t, g, unknown or other
aacaaaaaccaccaacgttggaggctcatcgttcctattcccccccccccccccccccccccccccaggcagatgttatcgaggtccgacnnnnnnctctcaaacccaaaataaaaat

SEQ ID NO: 730 - DNA, 118 bp, Artificial Sequence
  Description of Artificial Sequence: Synthetic polynucleotide
  modified_base (90)..(95): a, c, t, g, unknown or other
acttacaccaacacacaacttctaaaacgttggaggctcatcgttcctattccccccccccccccaggcagatgttatcgaggtccgacnnnnnntatatctcttattaatttccctt

SEQ ID NO: 731 - DNA, 118 bp, Artificial Sequence
  Description of Artificial Sequence: Synthetic polynucleotide
  modified_base (96)..(101): a, c, t, g, unknown or other
atccaacccatccaaagttggaggctcatcgttcctattccccccccccccccccccccccccccccccccaggcagatgttatcgaggtccgacnnnnnntcctacctttaccttct

SEQ ID NO: 732 - DNA, 118 bp, Artificial Sequence
  Description of Artificial Sequence: Synthetic polynucleotide
  modified_base (97)..(102): a, c, t, g, unknown or other
acaaaatactccaactcccgttggaggctcatcgttcctattccccccccccccccccccccccccccccccaggcagatgttatcgaggtccgacnnnnnnacaaaacaaccccatt

SEQ ID NO: 733 - DNA, 118 bp, Artificial Sequence
  Description of Artificial Sequence: Synthetic polynucleotide
  modified_base (95)..(100): a, c, t, g, unknown or other
atccctaaatataacaccaaagttggaggctcatcgttcctattccccccccccccccccccccccccccaggcagatgttatcgaggtccgacnnnnnnaaaaacaaacaaacctca

SEQ ID NO: 734 - DNA, 118 bp, Artificial Sequence
  Description of Artificial Sequence: Synthetic polynucleotide
  modified_base (93)..(98): a, c, t, g, unknown or other
ctataaataaatatcctttccacgttggaggctcatcgttcctattccccccccccccccccccccccaggcagatgttatcgaggtccgacnnnnnntaaaatctaaacaaccaaac

SEQ ID NO: 735 - DNA, 118 bp, Artificial Sequence
  Description of Artificial Sequence: Synthetic polynucleotide
  modified_base (94)..(99): a, c, t, g, unknown or other
attccaacaacctttcagttggaggctcatcgttcctattcccccccccccccccccccccccccccccaggcagatgttatcgaggtccgacnnnnnnaaaacaaacacaatcaaaa

SEQ ID NO: 736 - DNA, 118 bp, Artificial Sequence
  Description of Artificial Sequence: Synthetic polynucleotide
  modified_base (88)..(93): a, c, t, g, unknown or other
acctaaaaccctttctaaacaactctagttggaggctcatcgttcctattcccccccccccccaggcagatgttatcgaggtccgacnnnnnntcaacccccttcaaccttaaaataa

SEQ ID NO: 737 - DNA, 118 bp, Artificial Sequence
  Description of Artificial Sequence: Synthetic polynucleotide
  modified_base (92)..(97): a, c, t, g, unknown or other
atattattactccaccacaaccacaagttggaggctcatcgttcctattccccccccccccccccccaggcagatgttatcgaggtccgacnnnnnnaatataaaccaaatatcacac

SEQ ID NO: 738 - DNA, 118 bp, Artificial Sequence
  Description of Artificial Sequence: Synthetic polynucleotide
  modified_base (90)..(95): a, c, t, g, unknown or other
accaactactccataaccttaaacacctcatgttggaggctcatcgttcctattcccccccccccaggcagatgttatcgaggtccgacnnnnnntttcacctcttaataatctaact

SEQ ID NO: 739 - DNA, 118 bp, Artificial Sequence
  Description of Artificial Sequence: Synthetic polynucleotide
  modified_base (87)..(92): a, c, t, g, unknown or other
ctcaaaatctcttacttcccgttggaggctcatcgttcctattcccccccccccccccccccaggcagatgttatcgaggtccgacnnnnnnactttttaactttaaatataaaaacc

SEQ ID NO: 740 - DNA, 118 bp, Artificial Sequence
  Description of Artificial Sequence: Synthetic polynucleotide
  modified_base (95)..(100): a, c, t, g, unknown or other
ctctaccaactaactaaaacctgttggaggctcatcgttcctattcccccccccccccccccccccccccaggcagatgttatcgaggtccgacnnnnnnactatcctcattctcaaa

SEQ ID NO: 741 - DNA, 118 bp, Artificial Sequence
  Description of Artificial Sequence: Synthetic polynucleotide
  modified_base (95)..(100): a, c, t, g, unknown or other
ctcctaacactacaaaataactgttggaggctcatcgttcctattcccccccccccccccccccccccccaggcagatgttatcgaggtccgacnnnnnntacaacaaccaaaaccta

SEQ ID NO: 742 - DNA, 118 bp, Artificial Sequence
  Description of Artificial Sequence: Synthetic polynucleotide
  modified_base (96)..(101): a, c, t, g, unknown or other
cccaaacctcactcatacatcttgttggaggctcatcgttcctattcccccccccccccccccccccccccaggcagatgttatcgaggtccgacnnnnnnacaacactctatacacc

SEQ ID NO: 743 - DNA, 118 bp, Artificial Sequence
  Description of Artificial Sequence: Synthetic polynucleotide
  modified_base (89)..(94): a, c, t, g, unknown or other
tctcctcttaaaaaccaccagttggaggctcatcgttcctattcccccccccccccccccccccaggcagatgttatcgaggtccgacnnnnnnaaaaactaaaataaaccaacaatc

SEQ ID NO: 744 - DNA, 118 bp, Artificial Sequence
  Description of Artificial Sequence: Synthetic polynucleotide
  modified_base (95)..(100): a, c, t, g, unknown or other
tcttccaacactccctcaacaaaaagttggaggctcatcgttcctattccccccccccccccccccccccaggcagatgttatcgaggtccgacnnnnnnaataacaaacaaaaccct

SEQ ID NO: 745 - DNA, 118 bp, Artificial Sequence
  Description of Artificial Sequence: Synthetic polynucleotide
  modified_base (93)..(98): a, c, t, g, unknown or other
accaaaattcaaccctacgttggaggctcatcgttcctattcccccccccccccccccccccccccccaggcagatgttatcgaggtccgacnnnnnntaacctacataaacacacac

SEQ ID NO: 746 - DNA, 118 bp, Artificial Sequence
  Description of Artificial Sequence: Synthetic polynucleotide
  modified_base (93)..(98): a, c, t, g, unknown or other
aaaaatcaccaccatacaaaagttggaggctcatcgttcctattccccccccccccccccccccccccaggcagatgttatcgaggtccgacnnnnnnaacactctaaacaaattcta

SEQ ID NO: 747 - DNA, 118 bp, Artificial Sequence
  Description of Artificial Sequence: Synthetic polynucleotide
  modified_base (92)..(97): a, c, t, g, unknown or other
accccaacaattacccgttggaggctcatcgttcctattccccccccccccccccccccccccccccaggcagatgttatcgaggtccgacnnnnnnaaaatacaaattcaaacaact

SEQ ID NO: 748 - DNA, 118 bp, Artificial Sequence
  Description of Artificial Sequence: Synthetic polynucleotide
  modified_base (90)..(95): a, c, t, g, unknown or other
cacttcctttatatcaataacagttggaggctcatcgttcctattccccccccccccccccccccaggcagatgttatcgaggtccgacnnnnnnttttacaactacaaattcacatt

SEQ ID NO: 749 - DNA, 118 bp, Artificial Sequence
  Description of Artificial Sequence: Synthetic polynucleotide
  modified_base (85)..(90): a, c, t, g, unknown or other
tatcttcctaacaccttcgttggaggctcatcgttcctattcccccccccccccccccccaggcagatgttatcgaggtccgacnnnnnntcaaccaaattcctaactaaaactcttc

SEQ ID NO: 750 - DNA, 118 bp, Artificial Sequence
  Description of Artificial Sequence: Synthetic polynucleotide
  modified_base (92)..(97): a, c, t, g, unknown or other
aaacacacaaactacaatgttggaggctcatcgttcctattccccccccccccccccccccccccccaggcagatgttatcgaggtccgacnnnnnncaaatcacaaaatttcaaaaa

SEQ ID NO: 751 - DNA, 118 bp, Artificial Sequence
  Description of Artificial Sequence: Synthetic polynucleotide
  modified_base (93)..(98): a, c, t, g, unknown or other
ccttctattttaaaacacactgttggaggctcatcgttcctattccccccccccccccccccccccccaggcagatgttatcgaggtccgacnnnnnntaaacaacaaaaacttcaaa

SEQ ID NO: 752 - DNA, 118 bp, Artificial Sequence
  Description of Artificial Sequence: Synthetic polynucleotide
  modified_base (89)..(94): a, c, t, g, unknown or other
acaaaaacctctacttccaaaacgttggaggctcatcgttcctattccccccccccccccccccaggcagatgttatcgaggtccgacnnnnnnaaaaactatctaacatcactattt

SEQ ID NO: 753 - DNA, 118 bp, Artificial Sequence
  Description of Artificial Sequence: Synthetic polynucleotide
  modified_base (87)..(92): a, c, t, g, unknown or other
actacttacttcacataaaaataaccctgttggaggctcatcgttcctattcccccccccccaggcagatgttatcgaggtccgacnnnnnnttcctataaatattacatataacatt

SEQ ID NO: 754 - DNA, 118 bp, Artificial Sequence
  Description of Artificial Sequence: Synthetic polynucleotide
  modified_base (86)..(91): a, c, t, g, unknown or other
acctcaaactaccaaacttcctatccccgttggaggctcatcgttcctattccccccccccaggcagatgttatcgaggtccgacnnnnnnaccctctttcctatttcctatcctaaa

SEQ ID NO: 755 - DNA, 118 bp, Artificial Sequence
  Description of Artificial Sequence: Synthetic polynucleotide
  modified_base (94)..(99): a, c, t, g, unknown or other
cctcccaaccactattccctaacccactataagttggaggctcatcgttcctattccccccccccccccaggcagatgttatcgaggtccgacnnnnnnaaaacatctacataccctc

SEQ ID NO: 756 - DNA, 118 bp, Artificial Sequence
  Description of Artificial Sequence: Synthetic polynucleotide
  modified_base (90)..(95): a, c, t, g, unknown or other
cctctcaatccctataataagttggaggctcatcgttcctattccccccccccccccccccccccaggcagatgttatcgaggtccgacnnnnnntcaacacttcctactctaaactt

SEQ ID NO: 757 - DNA, 118 bp, Artificial Sequence
  Description of Artificial Sequence: Synthetic polynucleotide
  modified_base (93)..(98): a, c, t, g, unknown or other
tccctaaatcctttcctaaacaacgttggaggctcatcgttcctattcccccccccccccccccccccaggcagatgttatcgaggtccgacnnnnnntctaaccttctctatacttt

SEQ ID NO: 758 - DNA, 118 bp, Artificial Sequence
  Description of Artificial Sequence: Synthetic polynucleotide
  modified_base (92)..(97): a, c, t, g, unknown or other
tctctacctttattttccacagttggaggctcatcgttcctattcccccccccccccccccccccccaggcagatgttatcgaggtccgacnnnnnnttacactaaatcaaaaacaaa

SEQ ID NO: 759 - DNA, 118 bp, Artificial Sequence
  Description of Artificial Sequence: Synthetic polynucleotide
  modified_base (86)..(91): a, c, t, g, unknown or other
tccttaaatttcctttcccatccgttggaggctcatcgttcctattcccccccccccccccaggcagatgttatcgaggtccgacnnnnnnaataaccctcctaccaactctcccaaa

SEQ ID NO: 760 - DNA, 118 bp, Artificial Sequence
  Description of Artificial Sequence: Synthetic polynucleotide
  modified_base (90)..(95): a, c, t, g, unknown or other
cttcattcaactctcccgttggaggctcatcgttcctattcccccccccccccccccccccccccaggcagatgttatcgaggtccgacnnnnnntaaaaccacaaacaactctaaaa

SEQ ID NO: 761 - DNA, 118 bp, Artificial Sequence
  Description of Artificial Sequence: Synthetic polynucleotide
  modified_base (92)..(97): a, c, t, g, unknown or other
ataaaatcacaacaacccgttggaggctcatcgttcctattccccccccccccccccccccccccccaggcagatgttatcgaggtccgacnnnnnntccaaaaacaaaaacaaaaat

SEQ ID NO: 762 - DNA, 118 bp, Artificial Sequence
  Description of Artificial Sequence: Synthetic polynucleotide
  modified_base (94)..(99): a, c, t, g, unknown or other
ccctaaaaccccaatcaaagttggaggctcatcgttcctattcccccccccccccccccccccccccccaggcagatgttatcgaggtccgacnnnnnnaaaaaccttccacaaataa

SEQ ID NO: 763 - DNA, 118 bp, Artificial Sequence
  Description of Artificial Sequence: Synthetic polynucleotide
  modified_base (97)..(102): a, c, t, g, unknown or other
cctataactcttattctaccagttggaggctcatcgttcctattccccccccccccccccccccccccccccaggcagatgttatcgaggtccgacnnnnnncccttatcccaccttt

SEQ ID NO: 764 - DNA, 118 bp, Artificial Sequence
  Description of Artificial Sequence: Synthetic polynucleotide
  modified_base (94)..(99): a, c, t, g, unknown or other
aatccctcacaaacaaacgttggaggctcatcgttcctattccccccccccccccccccccccccccccaggcagatgttatcgaggtccgacnnnnnnacaacacaaaaactaacaa

SEQ ID NO: 765 - DNA, 118 bp, Artificial Sequence
  Description of Artificial Sequence: Synthetic polynucleotide
  modified_base (87)..(92): a, c, t, g, unknown or other
cctacaactttcccaagttggaggctcatcgttcctattcccccccccccccccccccccccaggcagatgttatcgaggtccgacnnnnnntaataaaccctctcatatataccttc

SEQ ID NO: 766 - DNA, 118 bp, Artificial Sequence
  Description of Artificial Sequence: Synthetic polynucleotide
  modified_base (96)..(101): a, c, t, g, unknown or other
attatccccaacccctacgttggaggctcatcgttcctattccccccccccccccccccccccccccccccaggcagatgttatcgaggtccgacnnnnnncatatacacaacaccca

SEQ ID NO: 767 - DNA, 118 bp, Artificial Sequence
  Description of Artificial Sequence: Synthetic polynucleotide
  modified_base (91)..(96): a, c, t, g, unknown or other
tcaaaatccaaacaaaaacccagttggaggctcatcgttcctattcccccccccccccccccccccaggcagatgttatcgaggtccgacnnnnnnaacaaatacaaaataaatacct

SEQ ID NO: 768 - DNA, 118 bp, Artificial Sequence
  Description of Artificial Sequence: Synthetic polynucleotide
  modified_base (95)..(100): a, c, t, g, unknown or other
acttccctaaatccctgttggaggctcatcgttcctattcccccccccccccccccccccccccccccccaggcagatgttatcgaggtccgacnnnnnnttcctttccactccccca

SEQ ID NO: 769 - DNA, 118 bp, Artificial Sequence
  Description of Artificial Sequence: Synthetic polynucleotide
  modified_base (90)..(95): a, c, t, g, unknown or other
taataaactaaaaacctacaaaaagttggaggctcatcgttcctattccccccccccccccccccaggcagatgttatcgaggtccgacnnnnnntatcccttattctaaaaactaaa

SEQ ID NO: 770 - DNA, 118 bp, Artificial Sequence
  Description of Artificial Sequence: Synthetic polynucleotide
  modified_base (93)..(98): a, c, t, g, unknown or other
acttcttctactaattaaaccgttggaggctcatcgttcctattccccccccccccccccccccccccaggcagatgttatcgaggtccgacnnnnnntaaaaataaacaaccaacca

SEQ ID NO: 771 - DNA, 118 bp, Artificial Sequence
  Description of Artificial Sequence: Synthetic polynucleotide
  modified_base (86)..(91): a, c, t, g, unknown or other
tccaactccaaaccctaattatcccgttggaggctcatcgttcctattcccccccccccccaggcagatgttatcgaggtccgacnnnnnnaaaacaactactatattcctcttaaac

SEQ ID NO: 772 - DNA, 118 bp, Artificial Sequence
  Description of Artificial Sequence: Synthetic polynucleotide
  modified_base (95)..(100): a, c, t, g, unknown or other
aaatctcacacaataaacaaacgttggaggctcatcgttcctattcccccccccccccccccccccccccaggcagatgttatcgaggtccgacnnnnnncccccaaccctctacctc

SEQ ID NO: 773 - DNA, 118 bp, Artificial Sequence
  Description of Artificial Sequence: Synthetic polynucleotide
  modified_base (94)..(99): a, c, t, g, unknown or other
caaaataaaccctaaatcatcttcgttggaggctcatcgttcctattccccccccccccccccccccccaggcagatgttatcgaggtccgacnnnnnncaaattctttccaaactac

SEQ ID NO: 774 - DNA, 118 bp, Artificial Sequence
  Description of Artificial Sequence: Synthetic polynucleotide
  modified_base (91)..(96): a, c, t, g, unknown or other
atcctcctcttaaatttactcttttaaaacagttggaggctcatcgttcctattccccccccccccaggcagatgttatcgaggtccgacnnnnnntatactcccaaaatcctaaaaa

SEQ ID NO: 775 - DNA, 118 bp, Artificial Sequence
  Description of Artificial Sequence: Synthetic polynucleotide
  modified_base (93)..(98): a, c, t, g, unknown or other
actcaaccccctttcctaaaaccaaaacttgttggaggctcatcgttcctattcccccccccccccccaggcagatgttatcgaggtccgacnnnnnnaaaattcatcccaattctaa

SEQ ID NO: 776 - DNA, 118 bp, Artificial Sequence
  Description of Artificial Sequence: Synthetic polynucleotide
  modified_base (88)..(93): a, c, t, g, unknown or other
accctcttaaaattctcaatcgttggaggctcatcgttcctattcccccccccccccccccccaggcagatgttatcgaggtccgacnnnnnnaattcctaaaatactaaaataaaat

SEQ ID NO: 777 - DNA, 118 bp, Artificial Sequence
  Description of Artificial Sequence: Synthetic polynucleotide
  modified_base (96)..(101): a, c, t, g, unknown or other
ctcccaaaacacaacaaaagttggaggctcatcgttcctattcccccccccccccccccccccccccccccaggcagatgttatcgaggtccgacnnnnnntctaaccaaacaccaaa

SEQ ID NO: 778 - DNA, 118 bp, Artificial Sequence
  Description of Artificial Sequence: Synthetic polynucleotide
  modified_base (87)..(92): a, c, t, g, unknown or other
actaaaacttccttttactccccaatgttggaggctcatcgttcctattcccccccccccccaggcagatgttatcgaggtccgacnnnnnnaaaaataaccttaaatttaataaaaa

SEQ ID NO: 779 - DNA, 118 bp, Artificial Sequence
  Description of Artificial Sequence: Synthetic polynucleotide
  modified_base (89)..(94): a, c, t, g, unknown or other
aaaaaccactacctaaaaagttggaggctcatcgttcctattccccccccccccccccccccccaggcagatgttatcgaggtccgacnnnnnnaccaatcttcattatctttaaaaa

SEQ ID NO: 780 - DNA, 118 bp, Artificial Sequence
  Description of Artificial Sequence: Synthetic polynucleotide
  modified_base (91)..(96): a, c, t, g, unknown or other
tctatttcccacacccctacccctatctaactgttggaggctcatcgttcctattcccccccccccaggcagatgttatcgaggtccgacnnnnnnatatctaatataaaacctccct

SEQ ID NO: 781 - DNA, 118 bp, Artificial Sequence
  Description of Artificial Sequence: Synthetic polynucleotide
  modified_base (87)..(92): a, c, t, g, unknown or other
ccccaactctcctaaaccgttggaggctcatcgttcctattcccccccccccccccccccccaggcagatgttatcgaggtccgacnnnnnnaaaaacacatacaaataactaacacc

SEQ ID NO: 782 - DNA, 118 bp, Artificial Sequence
  Description of Artificial Sequence: Synthetic polynucleotide
  modified_base (95)..(100): a, c, t, g, unknown or other
atctcctcctatttctaaatcgttggaggctcatcgttcctattccccccccccccccccccccccccccaggcagatgttatcgaggtccgacnnnnnnccccacttacatccaaca

SEQ ID NO: 783 - DNA, 118 bp, Artificial Sequence
  Description of Artificial Sequence: Synthetic polynucleotide
  modified_base (94)..(99): a, c, t, g, unknown or other
ccctatcttacttcaaactaccgttggaggctcatcgttcctattccccccccccccccccccccccccaggcagatgttatcgaggtccgacnnnnnnttcaacctcttctctaaaa

SEQ ID NO: 784 - DNA, 118 bp, Artificial Sequence
  Description of Artificial Sequence: Synthetic polynucleotide
  modified_base (94)..(99): a, c, t, g, unknown or other
ttcataactcaactcctaaatcaaatcgttggaggctcatcgttcctattcccccccccccccccccccaggcagatgttatcgaggtccgacnnnnnnaactaaacctaaacatacc

SEQ ID NO: 785 - DNA, 118 bp, Artificial Sequence
  Description of Artificial Sequence: Synthetic polynucleotide
  modified_base (89)..(94): a, c, t, g, unknown or other
actttctaacataactaattcaatgttggaggctcatcgttcctattcccccccccccccccccaggcagatgttatcgaggtccgacnnnnnnaacatatacatcctatattctata

SEQ ID NO: 786 - DNA, 118 bp, Artificial Sequence
  Description of Artificial Sequence: Synthetic polynucleotide
  modified_base (90)..(95): a, c, t, g, unknown or other
acactaaatttacaaatttctcgttggaggctcatcgttcctattccccccccccccccccccccaggcagatgttatcgaggtccgacnnnnnnaatcaaacaaataaataactttt

SEQ ID NO: 787 - DNA, 118 bp, Artificial Sequence
  Description of Artificial Sequence: Synthetic polynucleotide
  modified_base (85)..(90): a, c, t, g, unknown or other
actaccttccctcccaaaatctccaaataatgttggaggctcatcgttcctattccccccaggcagatgttatcgaggtccgacnnnnnnatacctctcaacccaactcctaacaaaa

SEQ ID NO: 788 - DNA, 118 bp, Artificial Sequence
  Description of Artificial Sequence: Synthetic polynucleotide
  modified_base (93)..(98): a, c, t, g, unknown or other
atataatttcaaaataaatcactcctccaagttggaggctcatcgttcctattcccccccccccccccaggcagatgttatcgaggtccgacnnnnnnataaaaccctccccttcaaa

SEQ ID NO: 789 - DNA, 118 bp, Artificial Sequence
  Description of Artificial Sequence: Synthetic polynucleotide
  modified_base (93)..(98): a, c, t, g, unknown or other
cttaacactattccaaatcactaagttggaggctcatcgttcctattcccccccccccccccccccccaggcagatgttatcgaggtccgacnnnnnnaaacttcctaaatacaacaa

SEQ ID NO: 790 - DNA, 118 bp, Artificial Sequence
  Description of Artificial Sequence: Synthetic polynucleotide
  modified_base (94)..(99): a, c, t, g, unknown or other
acccaaactctcctccacaaataaagttggaggctcatcgttcctattcccccccccccccccccccccaggcagatgttatcgaggtccgacnnnnnnaaactctaaaccccaaaaa

SEQ ID NO: 791 - DNA, 118 bp, Artificial Sequence
  Description of Artificial Sequence: Synthetic polynucleotide
  modified_base (92)..(97): a, c, t, g, unknown or other
ccataacccaaaacatcagttggaggctcatcgttcctattccccccccccccccccccccccccccaggcagatgttatcgaggtccgacnnnnnnaaaaataaaaactaaccactt

SEQ ID NO: 792 - DNA, 118 bp, Artificial Sequence
  Description of Artificial Sequence: Synthetic polynucleotide
  modified_base (93)..(98): a, c, t, g, unknown or other
acctataatcccaacacgttggaggctcatcgttcctattccccccccccccccccccccccccccccaggcagatgttatcgaggtccgacnnnnnnttaaatacacatctccaact

SEQ ID NO: 793 - DNA, 118 bp, Artificial Sequence
  Description of Artificial Sequence: Synthetic polynucleotide
  modified_base (88)..(93): a, c, t, g, unknown or other
actctccttaataaaattctccagttggaggctcatcgttcctattcccccccccccccccccaggcagatgttatcgaggtccgacnnnnnnaaaatacatattactattttccact

SEQ ID NO: 794 - DNA, 118 bp, Artificial Sequence
  Description of Artificial Sequence: Synthetic polynucleotide
  modified_base (88)..(93): a, c, t, g, unknown or other
tcacaaaatcacaacctccccaaaaacgttggaggctcatcgttcctattcccccccccccccaggcagatgttatcgaggtccgacnnnnnntaactttaaataaacaaaacttttt

SEQ ID NO: 795 - DNA, 118 bp, Artificial Sequence
  Description of Artificial Sequence: Synthetic polynucleotide
  modified_base (88)..(93): a, c, t, g, unknown or other
ccaccctctaacacttgttggaggctcatcgttcctattccccccccccccccccccccccccaggcagatgttatcgaggtccgacnnnnnnttacaaactaataaataatctcaat

SEQ ID NO: 796 - DNA, 118 bp, Artificial Sequence
  Description of Artificial Sequence: Synthetic polynucleotide
  modified_base (83)..(88): a, c, t, g, unknown or other
acccctaaaatacccctaaccagttggaggctcatcgttcctattcccccccccccccaggcagatgttatcgaggtccgacnnnnnnaaccttaaaaataaaactataaaaataact

SEQ ID NO: 797 - DNA, 118 bp, Artificial Sequence
  Description of Artificial Sequence: Synthetic polynucleotide
  modified_base (88)..(93): a, c, t, g, unknown or other
acaaataacacaccactacgttggaggctcatcgttcctattcccccccccccccccccccccaggcagatgttatcgaggtccgacnnnnnnaaatccacctaaaaatcttcaaaaa

SEQ ID NO: 798 - DNA, 118 bp, Artificial Sequence
  Description of Artificial Sequence: Synthetic polynucleotide
  modified_base (83)..(88): a, c, t, g, unknown or other
accaacttaaaacccaaaaccctgttggaggctcatcgttcctattccccccccccccaggcagatgttatcgaggtccgacnnnnnnttttactataatttaacatttccctccacc

SEQ ID NO: 799 - DNA, 118 bp, Artificial Sequence
  Description of Artificial Sequence: Synthetic polynucleotide
  modified_base (92)..(97): a, c, t, g, unknown or other
aatcataaacttccaaattaaagttggaggctcatcgttcctattccccccccccccccccccccccaggcagatgttatcgaggtccgacnnnnnnctaaaaacatatctaacctca

SEQ ID NO: 800 - DNA, 118 bp, Artificial Sequence
  Description of Artificial Sequence: Synthetic polynucleotide
  modified_base (95)..(100): a, c, t, g, unknown or other
ccttaaacaactctctctaccgttggaggctcatcgttcctattccccccccccccccccccccccccccaggcagatgttatcgaggtccgacnnnnnnaacccacctaaattactt

SEQ ID NO: 801 - DNA, 118 bp, Artificial Sequence
  Description of Artificial Sequence: Synthetic polynucleotide
  modified_base (90)..(95): a, c, t, g, unknown or other
ataacaacttcccttcctcaactacctaagttggaggctcatcgttcctattcccccccccccccaggcagatgttatcgaggtccgacnnnnnnaaaaacccaaccctttctaaaaa

SEQ ID NO: 802 - DNA, 118 bp, Artificial Sequence
  Description of Artificial Sequence: Synthetic polynucleotide
  modified_base (89)..(94): a, c, t, g, unknown or other
tatccaatcaaaaccataaaataaaagttggaggctcatcgttcctattcccccccccccccccaggcagatgttatcgaggtccgacnnnnnnaactatatctaaaacctattcatc

SEQ ID NO: 803 - DNA, 118 bp, Artificial Sequence
  Description of Artificial Sequence: Synthetic polynucleotide
  modified_base (88)..(93): a, c, t, g, unknown or other
actccctatcccaaactcaccttccagttggaggctcatcgttcctattccccccccccccccaggcagatgttatcgaggtccgacnnnnnntaacccaaaaccccaaaacacaaaa

SEQ ID NO: 804 - DNA, 118 bp, Artificial Sequence
  Description of Artificial Sequence: Synthetic polynucleotide
  modified_base (97)..(102): a, c, t, g, unknown or other
ataccaatctatctccccgttggaggctcatcgttcctattcccccccccccccccccccccccccccccccaggcagatgttatcgaggtccgacnnnnnnacattaccctacccca

SEQ ID NO: 805 - DNA, 118 bp, Artificial Sequence
  Description of Artificial Sequence: Synthetic polynucleotide
  modified_base (91)..(96): a, c, t, g, unknown or other
cttatcatatcaaaaacacacgttggaggctcatcgttcctattccccccccccccccccccccccaggcagatgttatcgaggtccgacnnnnnnccctccccacacaaacctcacc

SEQ ID NO: 806 - DNA, 118 bp, Artificial Sequence
  Description of Artificial Sequence: Synthetic polynucleotide
  modified_base (90)..(95): a, c, t, g, unknown or other
aaccaaaaccaatttacagttggaggctcatcgttcctattccccccccccccccccccccccccaggcagatgttatcgaggtccgacnnnnnnatcttttcttataatatcacttc

SEQ ID NO: 807 - DNA, 118 bp, Artificial Sequence
  Description of Artificial Sequence: Synthetic polynucleotide
  modified_base (97)..(102): a, c, t, g, unknown or other
acaaacacacacacacacacagttggaggctcatcgttcctattccccccccccccccccccccccccccccaggcagatgttatcgaggtccgacnnnnnnacacacacaatcacaa

SEQ ID NO: 808 - DNA, 118 bp, Artificial Sequence
  Description of Artificial Sequence: Synthetic polynucleotide
  modified_base (94)..(99): a, c, t, g, unknown or other
ttaccctaatatcctacattcttactccgttggaggctcatcgttcctattccccccccccccccccccaggcagatgttatcgaggtccgacnnnnnntttccaaaaactcatccaa

SEQ ID NO: 809 - DNA, 118 bp, Artificial Sequence
  Description of Artificial Sequence: Synthetic polynucleotide
  modified_base (91)..(96): a, c, t, g, unknown or other
attatctctaacaaaaataaaaatcaagttggaggctcatcgttcctattccccccccccccccccaggcagatgttatcgaggtccgacnnnnnnacctcctaacaataaataaaaa

SEQ ID NO: 810 - DNA, 118 bp, Artificial Sequence
  Description of Artificial Sequence: Synthetic polynucleotide
  modified_base (89)..(94): a, c, t, g, unknown or other
cttccttaactatccccgttggaggctcatcgttcctattccccccccccccccccccccccccaggcagatgttatcgaggtccgacnnnnnnaacttaaataaactcaattacaat

SEQ ID NO: 811 - DNA, 118 bp, Artificial Sequence
  Description of Artificial Sequence: Synthetic polynucleotide
  modified_base (96)..(101): a, c, t, g, unknown or other
accccacttcacaaaagttggaggctcatcgttcctattccccccccccccccccccccccccccccccccaggcagatgttatcgaggtccgacnnnnnntttaccaatctcctcct

SEQ ID NO: 812 - DNA, 118 bp, Artificial Sequence
  Description of Artificial Sequence: Synthetic polynucleotide
  modified_base (87)..(92): a, c, t, g, unknown or other
atctccccatccccaattactaactatgttggaggctcatcgttcctattccccccccccccaggcagatgttatcgaggtccgacnnnnnnaaacaccctaacatacatctataaat

SEQ ID NO: 813 - DNA, 118 bp, Artificial Sequence
  Description of Artificial Sequence: Synthetic polynucleotide
  modified_base (97)..(102): a, c, t, g, unknown or other
actttctcaccaacctgttggaggctcatcgttcctattcccccccccccccccccccccccccccccccccaggcagatgttatcgaggtccgacnnnnnntcccacctaccctaaa

SEQ ID NO: 814 - DNA, 118 bp, Artificial Sequence
  Description of Artificial Sequence: Synthetic polynucleotide
  modified_base (97)..(102): a, c, t, g, unknown or other
caataactattccctaaacagttggaggctcatcgttcctattcccccccccccccccccccccccccccccaggcagatgttatcgaggtccgacnnnnnnaacacaacccctacaa

SEQ ID NO: 815 - DNA, 118 bp, Artificial Sequence
  Description of Artificial Sequence: Synthetic polynucleotide
  modified_base (90)..(95): a, c, t, g, unknown or other
tctccctccaactaccaaacagttggaggctcatcgttcctattcccccccccccccccccccccaggcagatgttatcgaggtccgacnnnnnntttaaaaatttaaaaacacacta

SEQ ID NO: 816 - DNA, 118 bp, Artificial Sequence
  Description of Artificial Sequence: Synthetic polynucleotide
  modified_base (88)..(93): a, c, t, g, unknown or other
atccttcctttaaaactaatttaaaagttggaggctcatcgttcctattccccccccccccccaggcagatgttatcgaggtccgacnnnnnntctattaaaaactatttcctataaa

SEQ ID NO: 817 - DNA, 118 bp, Artificial Sequence
  Description of Artificial Sequence: Synthetic polynucleotide
  modified_base (90)..(95): a, c, t, g, unknown or other
acaaaattaaactaaaacaaccctccaaccctgttggaggctcatcgttcctattccccccccccaggcagatgttatcgaggtccgacnnnnnnttccccaaataccctttaaccat

SEQ ID NO: 818 - DNA, 118 bp, Artificial Sequence
  Description of Artificial Sequence: Synthetic polynucleotide
  modified_base (88)..(93): a, c, t, g, unknown or other
atactaacaactctccaactctcccctgttggaggctcatcgttcctattcccccccccccccaggcagatgttatcgaggtccgacnnnnnntaacccccaaatacaaaactattat

SEQ ID NO: 819 - DNA, 118 bp, Artificial Sequence
  Description of Artificial Sequence: Synthetic polynucleotide
  modified_base (90)..(95): a, c, t, g, unknown or other
ctccaaaacaaactcctcgttggaggctcatcgttcctattccccccccccccccccccccccccaggcagatgttatcgaggtccgacnnnnnnaattaaataaaatcaaaacaaca

SEQ ID NO: 820 - DNA, 118 bp, Artificial Sequence
  Description of Artificial Sequence: Synthetic polynucleotide
  modified_base (91)..(96): a, c, t, g, unknown or other
tcctcaaaacctacaacactacgttggaggctcatcgttcctattcccccccccccccccccccccaggcagatgttatcgaggtccgacnnnnnnaataacaacactatctcattaa

SEQ ID NO: 821 - DNA, 118 bp, Artificial Sequence
  Description of Artificial Sequence: Synthetic polynucleotide
  modified_base (93)..(98): a, c, t, g, unknown or other
aaaaatacctcacccaaaaagttggaggctcatcgttcctattcccccccccccccccccccccccccaggcagatgttatcgaggtccgacnnnnnntccaaattccaaactaaaaa

SEQ ID NO: 822 - DNA, 118 bp, Artificial Sequence
  Description of Artificial Sequence: Synthetic polynucleotide
  modified_base (92)..(97): a, c, t, g, unknown or other
ccaactcaacactaaatactagttggaggctcatcgttcctattcccccccccccccccccccccccaggcagatgttatcgaggtccgacnnnnnnaaaaacttcaattccaaatca

SEQ ID NO: 823 - DNA, 118 bp, Artificial Sequence
  Description of Artificial Sequence: Synthetic polynucleotide
  modified_base (94)..(99): a, c, t, g, unknown or other
cctcccttctttccaaaaagttggaggctcatcgttcctattcccccccccccccccccccccccccccaggcagatgttatcgaggtccgacnnnnnnaaaaacaacccctatcttc

SEQ ID NO: 824 - DNA, 118 bp, Artificial Sequence
  Description of Artificial Sequence: Synthetic polynucleotide
  modified_base (94)..(99): a, c, t, g, unknown or other
aactcatctaaatcaaacaactgttggaggctcatcgttcctattccccccccccccccccccccccccaggcagatgttatcgaggtccgacnnnnnnactctaaacaaacaacaaa

SEQ ID NO: 825 - DNA, 118 bp, Artificial Sequence
  Description of Artificial Sequence: Synthetic polynucleotide
  modified_base (90)..(95): a, c, t, g, unknown or other
cttaatcctcctaacaacttgttggaggctcatcgttcctattccccccccccccccccccccccaggcagatgttatcgaggtccgacnnnnnnaattaactactaactaaaaacaa

SEQ ID NO: 826 - DNA, 118 bp, Artificial Sequence
  Description of Artificial Sequence: Synthetic polynucleotide
  modified_base (94)..(99): a, c, t, g, unknown or other
acaatcctaaaccctccacgttggaggctcatcgttcctattcccccccccccccccccccccccccccaggcagatgttatcgaggtccgacnnnnnntccaacctaaacaacaaaa

SEQ ID NO: 827 - DNA, 118 bp, Artificial Sequence
  Description of Artificial Sequence: Synthetic polynucleotide
  modified_base (90)..(95): a, c, t, g, unknown or other
acctacctccctaaacaaaaaccccaaaaaccgttggaggctcatcgttcctattccccccccccaggcagatgttatcgaggtccgacnnnnnnaaaacttaataaaaccatttcct

SEQ ID NO: 828 - DNA, 118 bp, Artificial Sequence
  Description of Artificial Sequence: Synthetic polynucleotide
  modified_base (87)..(92): a, c, t, g, unknown or other
ccaaaccaaaatacaaaaagttggaggctcatcgttcctattccccccccccccccccccccaggcagatgttatcgaggtccgacnnnnnnaaaaattatacaatctctaaaataaa

SEQ ID NO: 829 - DNA, 118 bp, Artificial Sequence
  Description of Artificial Sequence: Synthetic polynucleotide
  modified_base (92)..(97): a, c, t, g, unknown or other
ctacctatcacaaaaatactgttggaggctcatcgttcctattccccccccccccccccccccccccaggcagatgttatcgaggtccgacnnnnnntcttcaaaaatacatttacct

SEQ ID NO: 830 - DNA, 118 bp, Artificial Sequence
  Description of Artificial Sequence: Synthetic polynucleotide
  modified_base (87)..(92): a, c, t, g, unknown or other
acacctcaacaattaaatttacctaatccgttggaggctcatcgttcctattccccccccccaggcagatgttatcgaggtccgacnnnnnnattaccttcccatatttatcaataaa

SEQ ID NO: 831 - DNA, 118 bp, Artificial Sequence
  Description of Artificial Sequence: Synthetic polynucleotide
  modified_base (85)..(90): a, c, t, g, unknown or other
taaaataaaacaaacaaaaatttcctaaatccgttggaggctcatcgttcctattcccccaggcagatgttatcgaggtccgacnnnnnncttttcctcccctacccttcaccctttc

SEQ ID NO: 832 - DNA, 118 bp, Artificial Sequence
  Description of Artificial Sequence: Synthetic polynucleotide
  modified_base (91)..(96): a, c, t, g, unknown or other
ataaaaatacaaaactatcacaaacgttggaggctcatcgttcctattccccccccccccccccccaggcagatgttatcgaggtccgacnnnnnnaataaatttaataaaactcccc

SEQ ID NO: 833 - DNA, 118 bp, Artificial Sequence
  Description of Artificial Sequence: Synthetic polynucleotide
  modified_base (94)..(99): a, c, t, g, unknown or other
ctcaatattacccaaactaaaagttggaggctcatcgttcctattccccccccccccccccccccccccaggcagatgttatcgaggtccgacnnnnnnactaatctccaactcctaa

SEQ ID NO: 834 - DNA, 118 bp, Artificial Sequence
  Description of Artificial Sequence: Synthetic polynucleotide
  modified_base (96)..(101): a, c, t, g, unknown or other
attccccaaaaactcatctgttggaggctcatcgttcctattcccccccccccccccccccccccccccccaggcagatgttatcgaggtccgacnnnnnnttaaattacaaccccca

SEQ ID NO: 835 - DNA, 118 bp, Artificial Sequence
  Description of Artificial Sequence: Synthetic polynucleotide
  modified_base (91)..(96): a, c, t, g, unknown or other
acataaacaataaaactaatactgttggaggctcatcgttcctattccccccccccccccccccccaggcagatgttatcgaggtccgacnnnnnnttaccaacataaattaacaaaa

SEQ ID NO: 836 - DNA, 118 bp, Artificial Sequence
  Description of Artificial Sequence: Synthetic polynucleotide
  modified_base (92)..(97): a, c, t, g, unknown or other
cttcaccctattcccagttggaggctcatcgttcctattccccccccccccccccccccccccccccaggcagatgttatcgaggtccgacnnnnnnttcaaataaaaccttacctac

SEQ ID NO: 837 - DNA, 118 bp, Artificial Sequence
  Description of Artificial Sequence: Synthetic polynucleotide
  modified_base (96)..(101): a, c, t, g, unknown or other
ctaaaatctcataaatcccttaaagttggaggctcatcgttcctattccccccccccccccccccccccccaggcagatgttatcgaggtccgacnnnnnnaaacccttaaaacacac

SEQ ID NO: 838 - DNA, 118 bp, Artificial Sequence
  Description of Artificial Sequence: Synthetic polynucleotide
  modified_base (89)..(94): a, c, t, g, unknown or other
aacctaaatcaaacttccgttggaggctcatcgttcctattcccccccccccccccccccccccaggcagatgttatcgaggtccgacnnnnnnttcactctaaaaatatctatcaaa

SEQ ID NO: 839 - DNA, 118 bp, Artificial Sequence
  Description of Artificial Sequence: Synthetic polynucleotide
  modified_base (96)..(101): a, c, t, g, unknown or other
ctactcactactcactcgttggaggctcatcgttcctattcccccccccccccccccccccccccccccccaggcagatgttatcgaggtccgacnnnnnnaaaaccaacaaaacacc

SEQ ID NO: 840 - DNA, 118 bp, Artificial Sequence
  Description of Artificial Sequence: Synthetic polynucleotide
  modified_base (96)..(101): a, c, t, g, unknown or other
cacaaatatataaatatctacctaataagttggaggctcatcgttcctattccccccccccccccccccccaggcagatgttatcgaggtccgacnnnnnnaaaaacaaccacaacaa

SEQ ID NO: 841 - DNA, 118 bp, Artificial Sequence
  Description of Artificial Sequence: Synthetic polynucleotide
  modified_base (90)..(95): a, c, t, g, unknown or other
ccaactccccctttcaagttggaggctcatcgttcctattcccccccccccccccccccccccccaggcagatgttatcgaggtccgacnnnnnnttctttcttcaaataccacatcc

SEQ ID NO: 842 - DNA, 118 bp, Artificial Sequence
  Description of Artificial Sequence: Synthetic polynucleotide
  modified_base (89)..(94): a, c, t, g, unknown or other
ccaaaacaaacccctctgttggaggctcatcgttcctattccccccccccccccccccccccccaggcagatgttatcgaggtccgacnnnnnnaaaactcaacccctaaaataaaaa

SEQ ID NO: 843 - DNA, 118 bp, Artificial Sequence
  Description of Artificial Sequence: Synthetic polynucleotide
  modified_base (94)..(99): a, c, t, g, unknown or other
ctaacacaaaaactaaccccgttggaggctcatcgttcctattccccccccccccccccccccccccccaggcagatgttatcgaggtccgacnnnnnntaccttatacaaccactaa

SEQ ID NO: 844 - DNA, 118 bp, Artificial Sequence
  Description of Artificial Sequence: Synthetic polynucleotide
  modified_base (90)..(95): a, c, t, g, unknown or other
ccaaaaacctaaccaccgttggaggctcatcgttcctattcccccccccccccccccccccccccaggcagatgttatcgaggtccgacnnnnnnaaaacctaaaatccaattaaaaa

SEQ ID NO: 845 - DNA, 118 bp, Artificial Sequence
  Description of Artificial Sequence: Synthetic polynucleotide
  modified_base (93)..(98): a, c, t, g, unknown or other
acacacaaatactactctgttggaggctcatcgttcctattcccccccccccccccccccccccccccaggcagatgttatcgaggtccgacnnnnnnatcatcctaaacactaaaaa

SEQ ID NO: 846 - DNA, 118 bp, Artificial Sequence
  Description of Artificial Sequence: Synthetic polynucleotide
  modified_base (94)..(99): a, c, t, g, unknown or other
atttaaaaacaaaacaaacccgttggaggctcatcgttcctattcccccccccccccccccccccccccaggcagatgttatcgaggtccgacnnnnnnttaacaacaacttctaaca

SEQ ID NO: 847 - DNA, 118 bp, Artificial Sequence
  Description of Artificial Sequence: Synthetic polynucleotide
  modified_base (94)..(99): a, c, t, g, unknown or other
ctacaacccaaaacaacaaaaagttggaggctcatcgttcctattccccccccccccccccccccccccaggcagatgttatcgaggtccgacnnnnnntaaaactcaaccttcacaa

SEQ ID NO: 848 - DNA, 118 bp, Artificial Sequence
  Description of Artificial Sequence: Synthetic polynucleotide
  modified_base (85)..(90): a, c, t, g, unknown or other
ataccaaaatccaaaactccctcaaacccgttggaggctcatcgttcctattccccccccaggcagatgttatcgaggtccgacnnnnnnttaattaatcaatttcacttcctctaaa

SEQ ID NO: 849 - DNA, 118 bp, Artificial Sequence
  Description of Artificial Sequence: Synthetic polynucleotide
  modified_base (87)..(92): a, c, t, g, unknown or other
acatttccctccacccacacatagttggaggctcatcgttcctattccccccccccccccccaggcagatgttatcgaggtccgacnnnnnnaatctattcaacataaaaaccttctt

SEQ ID NO: 850 - DNA, 118 bp, Artificial Sequence
  Description of Artificial Sequence: Synthetic polynucleotide
  modified_base (94)..(99): a, c, t, g, unknown or other
ctctaaaaccaccctatctctgttggaggctcatcgttcctattcccccccccccccccccccccccccaggcagatgttatcgaggtccgacnnnnnnaacctaacataacctaact

SEQ ID NO: 851 - DNA, 118 bp, Artificial Sequence
  Description of Artificial Sequence: Synthetic polynucleotide
  modified_base (87)..(92): a, c, t, g, unknown or other
atccctccaaacaacaccaactcacagttggaggctcatcgttcctattcccccccccccccaggcagatgttatcgaggtccgacnnnnnnttcccctctctccccaaaaactaact

SEQ ID NO: 852 - DNA, 118 bp, Artificial Sequence
  Description of Artificial Sequence: Synthetic polynucleotide
  modified_base (92)..(97): a, c, t, g, unknown or other
aaatccctctacattaaaaagttggaggctcatcgttcctattccccccccccccccccccccccccaggcagatgttatcgaggtccgacnnnnnnaaaaacaaaaatctactacct

SEQ ID NO: 853 - DNA, 118 bp, Artificial Sequence
  Description of Artificial Sequence: Synthetic polynucleotide
  modified_base (91)..(96): a, c, t, g, unknown or other
ccaaatacctacatcaaaactgttggaggctcatcgttcctattccccccccccccccccccccccaggcagatgttatcgaggtccgacnnnnnnaaaaactttaacataatcctcc

SEQ ID NO: 854 - DNA, 118 bp, Artificial Sequence
  Description of Artificial Sequence: Synthetic polynucleotide
  modified_base (95)..(100): a, c, t, g, unknown or other
acaaacaaccccttccacagttggaggctcatcgttcctattccccccccccccccccccccccccccccaggcagatgttatcgaggtccgacnnnnnntaacaccaaactaatccc

SEQ ID NO: 855 - DNA, 118 bp, Artificial Sequence
  Description of Artificial Sequence: Synthetic polynucleotide
  modified_base (90)..(95): a, c, t, g, unknown or other
aaccttaactataaccctcgttggaggctcatcgttcctattcccccccccccccccccccccccaggcagatgttatcgaggtccgacnnnnnnttctttttctatttttaaacaaa

SEQ ID NO: 856 - DNA, 118 bp, Artificial Sequence
  Description of Artificial Sequence: Synthetic polynucleotide
  modified_base (92)..(97): a, c, t, g, unknown or other
ccaaaccaactccattaacgttggaggctcatcgttcctattcccccccccccccccccccccccccaggcagatgttatcgaggtccgacnnnnnnaaaaactaaatatccaccctt

SEQ ID NO: 857 - DNA, 118 bp, Artificial Sequence
  Description of Artificial Sequence: Synthetic polynucleotide
  modified_base (92)..(97): a, c, t, g, unknown or other
acccacattttaaccaaaatcacaaacccagttggaggctcatcgttcctattccccccccccccccaggcagatgttatcgaggtccgacnnnnnnaaaatttcaataatcccaaat

SEQ ID NO: 858 - DNA, 118 bp, Artificial Sequence
  Description of Artificial Sequence: Synthetic polynucleotide
  modified_base (90)..(95): a, c, t, g, unknown or other
actcctcctcctacaatacataactaaacctgttggaggctcatcgttcctattcccccccccccaggcagatgttatcgaggtccgacnnnnnnttaattaaattcccatcaatatt

SEQ ID NO: 859 - DNA, 118 bp, Artificial Sequence
  Description of Artificial Sequence: Synthetic polynucleotide
  modified_base (91)..(96): a, c, t, g, unknown or other
atctttccaaataacctttttccatcccccacgttggaggctcatcgttcctattcccccccccccaggcagatgttatcgaggtccgacnnnnnntccctaaaaataaaatcccacc

SEQ ID NO: 860 - DNA, 118 bp, Artificial Sequence
  Description of Artificial Sequence: Synthetic polynucleotide
  modified_base (95)..(100): a, c, t, g, unknown or other
ccctttaacaaaacttttcgttggaggctcatcgttcctattccccccccccccccccccccccccccccaggcagatgttatcgaggtccgacnnnnnnccaaacattaacctacac

SEQ ID NO: 861 - DNA, 118 bp, Artificial Sequence
  Description of Artificial Sequence: Synthetic polynucleotide
  modified_base (97)..(102): a, c, t, g, unknown or other
atcctttcccacaatttgttggaggctcatcgttcctattccccccccccccccccccccccccccccccccaggcagatgttatcgaggtccgacnnnnnnaaactcttcccacact

SEQ ID NO: 862 - DNA, 118 bp, Artificial Sequence
  Description of Artificial Sequence: Synthetic polynucleotide
  modified_base (93)..(98): a, c, t, g, unknown or other
taaccctctaaactaccctaaaaatataaaagttggaggctcatcgttcctattccccccccccccccaggcagatgttatcgaggtccgacnnnnnncactctccctaaactctaaa

SEQ ID NO: 863 - DNA, 118 bp, Artificial Sequence
  Description of Artificial Sequence: Synthetic polynucleotide
  modified_base (94)..(99): a, c, t, g, unknown or other
taacttttaaattaataaaacaataaagttggaggctcatcgttcctattcccccccccccccccccccaggcagatgttatcgaggtccgacnnnnnnaaaaaccataactactcca

SEQ ID NO: 864 - DNA, 118 bp, Artificial Sequence
  Description of Artificial Sequence: Synthetic polynucleotide
  modified_base (92)..(97): a, c, t, g, unknown or other
tccctacctaactcaaattcaaccgttggaggctcatcgttcctattccccccccccccccccccccaggcagatgttatcgaggtccgacnnnnnntcttataacttctctactact

SEQ ID NO: 865 - DNA, 118 bp, Artificial Sequence
  Description of Artificial Sequence: Synthetic polynucleotide
  modified_base (91)..(96): a, c, t, g, unknown or other
cttcttacaactctaaacccgttggaggctcatcgttcctattcccccccccccccccccccccccaggcagatgttatcgaggtccgacnnnnnnaacttaacaaatatacaaactt

SEQ ID NO: 866 - DNA, 118 bp, Artificial Sequence
  Description of Artificial Sequence: Synthetic polynucleotide
  modified_base (91)..(96): a, c, t, g, unknown or other
acccttattccccacttatattcttcctcaagttggaggctcatcgttcctattccccccccccccaggcagatgttatcgaggtccgacnnnnnnttaaaatcttctcaaacctttt

SEQ ID NO: 867 - DNA, 118 bp, Artificial Sequence
  Description of Artificial Sequence: Synthetic polynucleotide
  modified_base (93)..(98): a, c, t, g, unknown or other
ccccaaaacttccaaactcttgttggaggctcatcgttcctattccccccccccccccccccccccccaggcagatgttatcgaggtccgacnnnnnnaaccattcactaaaaccttt

SEQ ID NO: 868 - DNA, 118 bp, Artificial Sequence
  Description of Artificial Sequence: Synthetic polynucleotide
  modified_base (92)..(97): a, c, t, g, unknown or other
ctcctactcttaacctacctgttggaggctcatcgttcctattccccccccccccccccccccccccaggcagatgttatcgaggtccgacnnnnnntcaaactaactctctccataa

SEQ ID NO: 869 - DNA, 118 bp, Artificial Sequence
  Description of Artificial Sequence: Synthetic polynucleotide
  modified_base (93)..(98): a, c, t, g, unknown or other
cctacaaatacctctacctaccgttggaggctcatcgttcctattcccccccccccccccccccccccaggcagatgttatcgaggtccgacnnnnnntcaaaaacaacaaaatcttt

SEQ ID NO: 870 - DNA, 118 bp, Artificial Sequence
  Description of Artificial Sequence: Synthetic polynucleotide
  modified_base (89)..(94): a, c, t, g, unknown or other
ctaaactcctaataaactcaagttggaggctcatcgttcctattccccccccccccccccccccaggcagatgttatcgaggtccgacnnnnnnttaaccaataaaactaaataacac

SEQ ID NO: 871 - DNA, 118 bp, Artificial Sequence
  Description of Artificial Sequence: Synthetic polynucleotide
  modified_base (94)..(99): a, c, t, g, unknown or other
ctaacatctacaataatcaaatattgttggaggctcatcgttcctattcccccccccccccccccccccaggcagatgttatcgaggtccgacnnnnnnaaattcacaaactctaact

SEQ ID NO: 872 - DNA, 118 bp, Artificial Sequence
  Description of Artificial Sequence: Synthetic polynucleotide
  modified_base (93)..(98): a, c, t, g, unknown or other
aaaaccaacttcctttcccgttggaggctcatcgttcctattccccccccccccccccccccccccccaggcagatgttatcgaggtccgacnnnnnnaaatcaaaacaaaccaaaaa

SEQ ID NO: 873 - DNA, 118 bp, Artificial Sequence
  Description of Artificial Sequence: Synthetic polynucleotide
  modified_base (88)..(93): a, c, t, g, unknown or other
ctcaaaactccaactactcgttggaggctcatcgttcctattcccccccccccccccccccccaggcagatgttatcgaggtccgacnnnnnntaaaactctaaaatactaaaacaaa

SEQ ID NO: 874 - DNA, 118 bp, Artificial Sequence
  Description of Artificial Sequence: Synthetic polynucleotide
  modified_base (94)..(99): a, c, t, g, unknown or other
tcaaacccactacttcataatcaaagttggaggctcatcgttcctattcccccccccccccccccccccaggcagatgttatcgaggtccgacnnnnnntcacacacacacataaaaa

SEQ ID NO: 875 - DNA, 118 bp, Artificial Sequence
  Description of Artificial Sequence: Synthetic polynucleotide
  modified_base (86)..(91): a, c, t, g, unknown or other
tctctccccctctatctctatctctctccgttggaggctcatcgttcctattcccccccccaggcagatgttatcgaggtccgacnnnnnntattttattaactctttctctataatt

SEQ ID NO: 876 - DNA, 118 bp, Artificial Sequence
  Description of Artificial Sequence: Synthetic polynucleotide
  modified_base (84)..(89): a, c, t, g, unknown or other
atttaaatactactaacacttcccgttggaggctcatcgttcctattccccccccccccaggcagatgttatcgaggtccgacnnnnnntcaacactcaaacaaatttaattatctct

SEQ ID NO: 877 - DNA, 118 bp, Artificial Sequence
  Description of Artificial Sequence: Synthetic polynucleotide
  modified_base (89)..(94): a, c, t, g, unknown or other
ccccaaacatcacaaagttggaggctcatcgttcctattcccccccccccccccccccccccccaggcagatgttatcgaggtccgacnnnnnnaaaatcttactatctcccctctaa

SEQ ID NO: 878 - DNA, 118 bp, Artificial Sequence
  Description of Artificial Sequence: Synthetic polynucleotide
  modified_base (91)..(96): a, c, t, g, unknown or other
cattcacaacttattattaatcagttggaggctcatcgttcctattccccccccccccccccccccaggcagatgttatcgaggtccgacnnnnnnactcaactaatactatatacac

SEQ ID NO: 879 - DNA, 118 bp, Artificial Sequence
  Description of Artificial Sequence: Synthetic polynucleotide
  modified_base (96)..(101): a, c, t, g, unknown or other
cctacacaaaacattatattcctgttggaggctcatcgttcctattcccccccccccccccccccccccccaggcagatgttatcgaggtccgacnnnnnnaactcaaactcccaaaa

SEQ ID NO: 880 - DNA, 118 bp, Artificial Sequence
  Description of Artificial Sequence: Synthetic polynucleotide
  modified_base (89)..(94): a, c, t, g, unknown or other
cttcctcccctcccccgttggaggctcatcgttcctattcccccccccccccccccccccccccaggcagatgttatcgaggtccgacnnnnnnaaaaattaaatccctaaaataaaa

SEQ ID NO: 881 - DNA, 118 bp, Artificial Sequence
  Description of Artificial Sequence: Synthetic polynucleotide
  modified_base (92)..(97): a, c, t, g, unknown or other
caaaatccaaaacaccatccgttggaggctcatcgttcctattccccccccccccccccccccccccaggcagatgttatcgaggtccgacnnnnnnaccactataactataaacaaa

SEQ ID NO: 882 - DNA, 118 bp, Artificial Sequence
  Description of Artificial Sequence: Synthetic polynucleotide
  modified_base (91)..(96): a, c, t, g, unknown or other
actcatctaacaaccaaccacagttggaggctcatcgttcctattcccccccccccccccccccccaggcagatgttatcgaggtccgacnnnnnnatctacaatacactaaacccaa

SEQ ID NO: 883 - DNA, 118 bp, Artificial Sequence
  Description of Artificial Sequence: Synthetic polynucleotide
  modified_base (94)..(99): a, c, t, g, unknown or other
acccaaaactctacaccgttggaggctcatcgttcctattcccccccccccccccccccccccccccccaggcagatgttatcgaggtccgacnnnnnntaacatcaccaaactctaa

SEQ ID NO: 884 - DNA, 118 bp, Artificial Sequence
  Description of Artificial Sequence: Synthetic polynucleotide
  modified_base (94)..(99): a, c, t, g, unknown or other
acactaacctacctataaaatacgttggaggctcatcgttcctattcccccccccccccccccccccccaggcagatgttatcgaggtccgacnnnnnnaaaaacaaacaaacaaaca

SEQ ID NO: 885 - DNA, 118 bp, Artificial Sequence
  Description of Artificial Sequence: Synthetic polynucleotide
  modified_base (86)..(91): a, c, t, g, unknown or other
actcaataaaaccaaccttacctccaacgttggaggctcatcgttcctattccccccccccaggcagatgttatcgaggtccgacnnnnnnaacaaacaatacctttacccaacacct

SEQ ID NO: 886 - DNA, 118 bp, Artificial Sequence
  Description of Artificial Sequence: Synthetic polynucleotide
  modified_base (89)..(94): a, c, t, g, unknown or other
aaaacttactaaaatcacaacaactgttggaggctcatcgttcctattccccccccccccccccaggcagatgttatcgaggtccgacnnnnnnaaaattccctctcctacctaaacc

SEQ ID NO: 887 - DNA, 118 bp, Artificial Sequence
  Description of Artificial Sequence: Synthetic polynucleotide
  modified_base (86)..(91): a, c, t, g, unknown or other
tcacttccttaactatccccgttggaggctcatcgttcctattccccccccccccccccccaggcagatgttatcgaggtccgacnnnnnntcaacttaaataaactcaattacaata

SEQ ID NO: 888 - DNA, 118 bp, Artificial Sequence
  Description of Artificial Sequence: Synthetic polynucleotide
  modified_base (90)..(95): a, c, t, g, unknown or other
ataaattcacaccataaaacaaagttggaggctcatcgttcctattcccccccccccccccccccaggcagatgttatcgaggtccgacnnnnnnaaaaatcaaattttcaaaaccaa

SEQ ID NO: 889 - DNA, 118 bp, Artificial Sequence
  Description of Artificial Sequence: Synthetic polynucleotide
  modified_base (94)..(99): a, c, t, g, unknown or other
ccaacaacctttcatccaaaagttggaggctcatcgttcctattcccccccccccccccccccccccccaggcagatgttatcgaggtccgacnnnnnnaaaacaaacacaatcaaaa

SEQ ID NO: 890 - DNA, 118 bp, Artificial Sequence
  Description of Artificial Sequence: Synthetic polynucleotide
  modified_base (87)..(92): a, c, t, g, unknown or other
tcacactatattaccccacagttggaggctcatcgttcctattcccccccccccccccccccaggcagatgttatcgaggtccgacnnnnnntactcttctactaacatttcctatta

SEQ ID NO: 891 - DNA, 118 bp, Artificial Sequence
  Description of Artificial Sequence: Synthetic polynucleotide
  modified_base (91)..(96): a, c, t, g, unknown or other
cctaacaaaactcctaaactaccgttggaggctcatcgttcctattccccccccccccccccccccaggcagatgttatcgaggtccgacnnnnnnaacaaaaacaactaaataaaac

SEQ ID NO: 892 - DNA, 118 bp, Artificial Sequence
  Description of Artificial Sequence: Synthetic polynucleotide
  modified_base (93)..(98): a, c, t, g, unknown or other
ttaacaaataacacaccactacctcgttggaggctcatcgttcctattccccccccccccccccccccaggcagatgttatcgaggtccgacnnnnnnaaaatccaactaaaaacctt

SEQ ID NO: 893 - DNA, 118 bp, Artificial Sequence
  Description of Artificial Sequence: Synthetic polynucleotide
  modified_base (87)..(92): a, c, t, g, unknown or other
acttaatatctttccttaaacctcaactaaacgttggaggctcatcgttcctattcccccccaggcagatgttatcgaggtccgacnnnnnnttcacaattttcctatcaattaaccc

SEQ ID NO: 894 - DNA, 118 bp, Artificial Sequence
  Description of Artificial Sequence: Synthetic polynucleotide
  modified_base (91)..(96): a, c, t, g, unknown or other
acctcacccccaaaaacccaaaaccgttggaggctcatcgttcctattccccccccccccccccccaggcagatgttatcgaggtccgacnnnnnnaaaacccttccttaaataatat

SEQ ID NO: 895 - DNA, 118 bp, Artificial Sequence
  Description of Artificial Sequence: Synthetic polynucleotide
  modified_base (86)..(91): a, c, t, g, unknown or other
ttatatcttcctaacaccttgttggaggctcatcgttcctattccccccccccccccccccaggcagatgttatcgaggtccgacnnnnnntcaaccaaattcctaactaaaactctt

SEQ ID NO: 896 - DNA, 118 bp, Artificial Sequence
  Description of Artificial Sequence: Synthetic polynucleotide
  modified_base (89)..(94): a, c, t, g, unknown or other
cccataacatctccatattctgttggaggctcatcgttcctattccccccccccccccccccccaggcagatgttatcgaggtccgacnnnnnntctctctccctcactcactcacac

SEQ ID NO: 897 - DNA, 118 bp, Artificial Sequence
  Description of Artificial Sequence: Synthetic polynucleotide
  modified_base (94)..(99): a, c, t, g, unknown or other
acaacctataaaaactaaaaatcaattcttcgttggaggctcatcgttcctattcccccccccccccccaggcagatgttatcgaggtccgacnnnnnntcaaataaaacccttctcc

SEQ ID NO: 898 - DNA, 118 bp, Artificial Sequence
  Description of Artificial Sequence: Synthetic polynucleotide
  modified_base (93)..(98): a, c, t, g, unknown or other
tcctttttaaaaacctaaaaatccgttggaggctcatcgttcctattcccccccccccccccccccccaggcagatgttatcgaggtccgacnnnnnncaaaatactaaccacaatac

SEQ ID NO: 899 - DNA, 118 bp, Artificial Sequence
  Description of Artificial Sequence: Synthetic polynucleotide
  modified_base (93)..(98): a, c, t, g, unknown or other
ctaccttaaacccaacaaagttggaggctcatcgttcctattccccccccccccccccccccccccccaggcagatgttatcgaggtccgacnnnnnntactccataaccaactacaa

SEQ ID NO: 900 - DNA, 118 bp, Artificial Sequence
  Description of Artificial Sequence: Synthetic polynucleotide
  modified_base (97)..(102): a, c, t, g, unknown or other
actccctaaccctttctaaaagttggaggctcatcgttcctattccccccccccccccccccccccccccccaggcagatgttatcgaggtccgacnnnnnncccaccaactcctcca

SEQ ID NO: 901 - DNA, 118 bp, Artificial Sequence
  Description of Artificial Sequence: Synthetic polynucleotide
  modified_base (94)..(99): a, c, t, g, unknown or other
ccatactaatatcacttaatataatgttggaggctcatcgttcctattcccccccccccccccccccccaggcagatgttatcgaggtccgacnnnnnnaaactcatacctaatctct

SEQ ID NO: 902 - DNA, 118 bp, Artificial Sequence
  Description of Artificial Sequence: Synthetic polynucleotide
  modified_base (91)..(96): a, c, t, g, unknown or other
cccccttctcatccctcactattaccactcgttggaggctcatcgttcctattcccccccccccccaggcagatgttatcgaggtccgacnnnnnnttaaatccctaaaataaaaacc

SEQ ID NO: 903 - DNA, 118 bp, Artificial Sequence
  Description of Artificial Sequence: Synthetic polynucleotide
  modified_base (92)..(97): a, c, t, g, unknown or other
taaaatcacctttaccccaccccgttggaggctcatcgttcctattcccccccccccccccccccccaggcagatgttatcgaggtccgacnnnnnnaaaaacctctaatacctttat

SEQ ID NO: 904 - DNA, 118 bp, Artificial Sequence
  Description of Artificial Sequence: Synthetic polynucleotide
  modified_base (89)..(94): a, c, t, g, unknown or other
attccaattaccccatttacaagttggaggctcatcgttcctattcccccccccccccccccccaggcagatgttatcgaggtccgacnnnnnnaaaactaccatttcctaaaaacaa

SEQ ID NO: 905 - DNA, 118 bp, Artificial Sequence
  Description of Artificial Sequence: Synthetic polynucleotide
  modified_base (93)..(98): a, c, t, g, unknown or other
acccaacaacccctaacgttggaggctcatcgttcctattccccccccccccccccccccccccccccaggcagatgttatcgaggtccgacnnnnnnacccctttaaacctaaatat

SEQ ID NO: 906 - DNA, 118 bp, Artificial Sequence
  Description of Artificial Sequence: Synthetic polynucleotide
  modified_base (81)..(86): a, c, t, g, unknown or other
acttaaaacctaaaccctcagttggaggctcatcgttcctattcccccccccccccaggcagatgttatcgaggtccgacnnnnnnttatttttctaatatttaactacatactaaaa

SEQ ID NO: 907 - DNA, 118 bp, Artificial Sequence
  Description of Artificial Sequence: Synthetic polynucleotide
  modified_base (88)..(93): a, c, t, g, unknown or other
tatatacacacacacaacctccccctccgttggaggctcatcgttcctattccccccccccccaggcagatgttatcgaggtccgacnnnnnntatctccctaccaaccccctcaacc

SEQ ID NO: 908 - DNA, 118 bp, Artificial Sequence
  Description of Artificial Sequence: Synthetic polynucleotide
  modified_base (97)..(102): a, c, t, g, unknown or other
accctaaactatcaccagttggaggctcatcgttcctattccccccccccccccccccccccccccccccccaggcagatgttatcgaggtccgacnnnnnnttcctcctaccccacc

SEQ ID NO: 909 - DNA, 118 bp, Artificial Sequence
  Description of Artificial Sequence: Synthetic polynucleotide
  modified_base (86)..(91): a, c, t, g, unknown or other
acctcatataacaataacaataaaaagttggaggctcatcgttcctattccccccccccccaggcagatgttatcgaggtccgacnnnnnnacaacattatttaatatttattttatt

SEQ ID NO: 910 - DNA, 118 bp, Artificial Sequence
  Description of Artificial Sequence: Synthetic polynucleotide
  modified_base (94)..(99): a, c, t, g, unknown or other
cctctttctctaaaaccaaatgttggaggctcatcgttcctattcccccccccccccccccccccccccaggcagatgttatcgaggtccgacnnnnnnacctaaaacctaaacaaaa

SEQ ID NO: 911 - DNA, 118 bp, Artificial Sequence
  Description of Artificial Sequence: Synthetic polynucleotide
  modified_base (89)..(94): a, c, t, g, unknown or other
attctacaaaatattctccttttattcctgttggaggctcatcgttcctattccccccccccccaggcagatgttatcgaggtccgacnnnnnnaattaaacatcctaactactatat

SEQ ID NO: 912 - DNA, 118 bp, Artificial Sequence
  Description of Artificial Sequence: Synthetic polynucleotide
  modified_base (92)..(97): a, c, t, g, unknown or other
acctcaaaaactcaataacttaccaaacctgttggaggctcatcgttcctattccccccccccccccaggcagatgttatcgaggtccgacnnnnnnatttcaaaaccacacataaat

SEQ ID NO: 913 - DNA, 118 bp, Artificial Sequence
  Description of Artificial Sequence: Synthetic polynucleotide
  modified_base (92)..(97): a, c, t, g, unknown or other
cctccaaactcccaaatgttggaggctcatcgttcctattcccccccccccccccccccccccccccaggcagatgttatcgaggtccgacnnnnnnaacctttccacactttaaatt

SEQ ID NO: 914 - DNA, 118 bp, Artificial Sequence
  Description of Artificial Sequence: Synthetic polynucleotide
  modified_base (89)..(94): a, c, t, g, unknown or other
acacaattcttccaaaattacaaaagttggaggctcatcgttcctattccccccccccccccccaggcagatgttatcgaggtccgacnnnnnnattccaaaactacaaatattctct

SEQ ID NO: 915 - DNA, 118 bp, Artificial Sequence
  Description of Artificial Sequence: Synthetic polynucleotide
  modified_base (91)..(96): a, c, t, g, unknown or other
ctccaaaacaactatcaagttggaggctcatcgttcctattcccccccccccccccccccccccccaggcagatgttatcgaggtccgacnnnnnntcttcaactttactcactataa

SEQ ID NO: 916 - DNA, 118 bp, Artificial Sequence
  Description of Artificial Sequence: Synthetic polynucleotide
  modified_base (93)..(98): a, c, t, g, unknown or other
aaccaaaccacatactaaaagttggaggctcatcgttcctattcccccccccccccccccccccccccaggcagatgttatcgaggtccgacnnnnnnaaaaaccttcaacttaaaaa

SEQ ID NO: 917 - DNA, 118 bp, Artificial Sequence
  Description of Artificial Sequence: Synthetic polynucleotide
  modified_base (94)..(99): a, c, t, g, unknown or other
ctacctcactaacaacacacgttggaggctcatcgttcctattccccccccccccccccccccccccccaggcagatgttatcgaggtccgacnnnnnnaaataccctctacattcct

SEQ ID NO: 918 - DNA, 118 bp, Artificial Sequence
  Description of Artificial Sequence: Synthetic polynucleotide
  modified_base (89)..(94): a, c, t, g, unknown or other
cctctacctctctcatgttggaggctcatcgttcctattcccccccccccccccccccccccccaggcagatgttatcgaggtccgacnnnnnnataaaatctactaataaaatcact

SEQ ID NO: 919 - DNA, 118 bp, Artificial Sequence; identical to SEQ ID NO: 180
  Description of Artificial Sequence: Synthetic polynucleotide
  modified_base (97)..(102): a, c, t, g, unknown or other

SEQ ID NO: 920 - DNA, 118 bp, Artificial Sequence
  Description of Artificial Sequence: Synthetic polynucleotide
  modified_base (89)..(94): a, c, t, g, unknown or other
tcccatctcaaaatcctccaacagttggaggctcatcgttcctattccccccccccccccccccaggcagatgttatcgaggtccgacnnnnnntttcaaactactaacttattaata

SEQ ID NO: 921 - DNA, 118 bp, Artificial Sequence
  Description of Artificial Sequence: Synthetic polynucleotide
  modified_base (89)..(94): a, c, t, g, unknown or other
ccaaattcaactaaacccccaaagttggaggctcatcgttcctattccccccccccccccccccaggcagatgttatcgaggtccgacnnnnnnaaaacataaaaacaaaaataaaaa

SEQ ID NO: 922 - DNA, 118 bp, Artificial Sequence
  Description of Artificial Sequence: Synthetic polynucleotide
  modified_base (86)..(91): a, c, t, g, unknown or other
aactctttcctctaaaccctattaaaagttggaggctcatcgttcctattcccccccccccaggcagatgttatcgaggtccgacnnnnnnaactccattaacaaatcccctaacaac

SEQ ID NO: 923 - DNA, 118 bp, Artificial Sequence
  Description of Artificial Sequence: Synthetic polynucleotide
  modified_base (94)..(99): a, c, t, g, unknown or other
ccaaatttctaccttcctatttctgttggaggctcatcgttcctattccccccccccccccccccccccaggcagatgttatcgaggtccgacnnnnnntaaatacaaaaactccaca

SEQ ID NO: 924 - DNA, 118 bp, Artificial Sequence
  Description of Artificial Sequence: Synthetic polynucleotide
  modified_base (92)..(97): a, c, t, g, unknown or other
acaaaaaccaaaaactccgttggaggctcatcgttcctattccccccccccccccccccccccccccaggcagatgttatcgaggtccgacnnnnnnaactaaactcacaaactaaaa

SEQ ID NO: 925 - DNA, 118 bp, Artificial Sequence
  Description of Artificial Sequence: Synthetic polynucleotide
  modified_base (97)..(102): a, c, t, g, unknown or other
acttcttccaacatatcccgttggaggctcatcgttcctattccccccccccccccccccccccccccccccaggcagatgttatcgaggtccgacnnnnnntcactcaacaccaaaa

SEQ ID NO: 926 - DNA, 118 bp, Artificial Sequence
  Description of Artificial Sequence: Synthetic polynucleotide
  modified_base (87)..(92): a, c, t, g, unknown or other
acacactccttcaatttcgttggaggctcatcgttcctattcccccccccccccccccccccaggcagatgttatcgaggtccgacnnnnnnaaaacaacaataccaacaacaaaatt

SEQ ID NO: 927 - DNA, 118 bp, Artificial Sequence
  Description of Artificial Sequence: Synthetic polynucleotide
  modified_base (94)..(99): a, c, t, g, unknown or other
acttcctatccctcccgttggaggctcatcgttcctattccccccccccccccccccccccccccccccaggcagatgttatcgaggtccgacnnnnnncacataaacaacctttaca

SEQ ID NO: 928 - DNA, 118 bp, Artificial Sequence
  Description of Artificial Sequence: Synthetic polynucleotide
  modified_base (93)..(98): a, c, t, g, unknown or other
tccttcctcttctccctaactctcctctccgttggaggctcatcgttcctattcccccccccccccccaggcagatgttatcgaggtccgacnnnnnnaaactaaatctctacaactc

SEQ ID NO: 929 - DNA, 118 bp, Artificial Sequence
  Description of Artificial Sequence: Synthetic polynucleotide
  modified_base (97)..(102): a, c, t, g, unknown or other
acaccctaaaacccaaagttggaggctcatcgttcctattccccccccccccccccccccccccccccccccaggcagatgttatcgaggtccgacnnnnnnaaaccccaaacaaaac

SEQ ID NO: 930 - DNA, 118 bp, Artificial Sequence
  Description of Artificial Sequence: Synthetic polynucleotide
  modified_base (97)..(102): a, c, t, g, unknown or other
acctttcttcccctcagttggaggctcatcgttcctattcccccccccccccccccccccccccccccccccaggcagatgttatcgaggtccgacnnnnnncccccaaacccattct

SEQ ID NO: 931 - DNA, 118 bp, Artificial Sequence
  Description of Artificial Sequence: Synthetic polynucleotide
  modified_base (96)..(101): a, c, t, g, unknown or other
cctaaataatatccttatacctacgttggaggctcatcgttcctattccccccccccccccccccccccccaggcagatgttatcgaggtccgacnnnnnnctcaatcccaaacaatc

SEQ ID NO: 932 - DNA, 118 bp, Artificial Sequence
  Description of Artificial Sequence: Synthetic polynucleotide
  modified_base (88)..(93): a, c, t, g, unknown or other
atttactactccttacccttccataaagttggaggctcatcgttcctattcccccccccccccaggcagatgttatcgaggtccgacnnnnnnaaatccaatattttaatataaacat

SEQ ID NO: 933 - DNA, 118 bp, Artificial Sequence
  Description of Artificial Sequence: Synthetic polynucleotide
  modified_base (91)..(96): a, c, t, g, unknown or other
actcttccctatccctgttggaggctcatcgttcctattcccccccccccccccccccccccccccaggcagatgttatcgaggtccgacnnnnnnaaaactaccaacctaaactttt

SEQ ID NO: 934 - DNA, 118 bp, Artificial Sequence
  Description of Artificial Sequence: Synthetic polynucleotide
  modified_base (91)..(96): a, c, t, g, unknown or other
ccaactccctacaacataatgttggaggctcatcgttcctattcccccccccccccccccccccccaggcagatgttatcgaggtccgacnnnnnnacataatcctaaaaactaacac

SEQ ID NO: 935 - DNA, 118 bp, Artificial Sequence
  Description of Artificial Sequence: Synthetic polynucleotide
  modified_base (94)..(99): a, c, t, g, unknown or other
ctccataattaaacccaccagttggaggctcatcgttcctattccccccccccccccccccccccccccaggcagatgttatcgaggtccgacnnnnnnaaacaaacctcaacttacc

SEQ ID NO: 936 - DNA, 118 bp, Artificial Sequence
  Description of Artificial Sequence: Synthetic polynucleotide
  modified_base (92)..(97): a, c, t, g, unknown or other
cctcctaaacaaaaccaatgttggaggctcatcgttcctattcccccccccccccccccccccccccaggcagatgttatcgaggtccgacnnnnnnaaaccaaaactattacaaatt

SEQ ID NO: 937 - DNA, 118 bp, Artificial Sequence
  Description of Artificial Sequence: Synthetic polynucleotide
  modified_base (97)..(102): a, c, t, g, unknown or other
acccacccaatcccaagttggaggctcatcgttcctattcccccccccccccccccccccccccccccccccaggcagatgttatcgaggtccgacnnnnnntccctccattctccca

SEQ ID NO: 938 - DNA, 118 bp, Artificial Sequence
  Description of Artificial Sequence: Synthetic polynucleotide
  modified_base (95)..(100): a, c, t, g, unknown or other
aattacattcacaactctcactgttggaggctcatcgttcctattcccccccccccccccccccccccccaggcagatgttatcgaggtccgacnnnnnnaaaacttcaccacaaaaa

SEQ ID NO: 939 - DNA, 118 bp, Artificial Sequence
  Description of Artificial Sequence: Synthetic polynucleotide
  modified_base (86)..(91): a, c, t, g, unknown or other
atttctcattcctcttcccacccaaaccagttggaggctcatcgttcctattcccccccccaggcagatgttatcgaggtccgacnnnnnnaaaattctaatctaattaatctaaaat

SEQ ID NO: 940 - DNA, 118 bp, Artificial Sequence
  Description of Artificial Sequence: Synthetic polynucleotide
  modified_base (89)..(94): a, c, t, g, unknown or other
ccctccaccctatccacaaaaacagttggaggctcatcgttcctattcccccccccccccccccaggcagatgttatcgaggtccgacnnnnnnataacttatatatattcattccca

SEQ ID NO: 941 - DNA, 118 bp, Artificial Sequence
  Description of Artificial Sequence: Synthetic polynucleotide
  modified_base (90)..(95): a, c, t, g, unknown or other
actcaaaacttatttccctccttcaaaatatgttggaggctcatcgttcctattcccccccccccaggcagatgttatcgaggtccgacnnnnnnacatacctatatttccatctaat

SEQ ID NO: 942 - DNA, 118 bp, Artificial Sequence
  Description of Artificial Sequence: Synthetic polynucleotide
  modified_base (91)..(96): a, c, t, g, unknown or other
taaataaatctcctccaaaactaaaagttggaggctcatcgttcctattcccccccccccccccccaggcagatgttatcgaggtccgacnnnnnncactatataaacactactctaa

SEQ ID NO: 943 - DNA, 118 bp, Artificial Sequence
  Description of Artificial Sequence: Synthetic polynucleotide
  modified_base (91)..(96): a, c, t, g, unknown or other
actccctatatcaccacgttggaggctcatcgttcctattccccccccccccccccccccccccccaggcagatgttatcgaggtccgacnnnnnnccttataaaatccctaatatca

SEQ ID NO: 944 - DNA, 118 bp, Artificial Sequence
  Description of Artificial Sequence: Synthetic polynucleotide
  modified_base (91)..(96): a, c, t, g, unknown or other
ttatatcttcctaacaccttcgttggaggctcatcgttcctattccccccccccccccccccccccaggcagatgttatcgaggtccgacnnnnnnaaattcctaactaaaactcttc

SEQ ID NO: 945 - DNA, 118 bp, Artificial Sequence
  Description of Artificial Sequence: Synthetic polynucleotide
  modified_base (81)..(86): a, c, t, g, unknown or other
atataactcacaaccccttcctacccgttggaggctcatcgttcctattcccccccaggcagatgttatcgaggtccgacnnnnnnaatattactatcatcacacattacttttattt

SEQ ID NO: 946 - DNA, 118 bp, Artificial Sequence
  Description of Artificial Sequence: Synthetic polynucleotide
  modified_base (88)..(93): a, c, t, g, unknown or other
cttctatacactactcctctatgttggaggctcatcgttcctattccccccccccccccccccaggcagatgttatcgaggtccgacnnnnnntctttaaaacttaataaaaacaaaa

SEQ ID NO: 947 - DNA, 118 bp, Artificial Sequence
  Description of Artificial Sequence: Synthetic polynucleotide
  modified_base (92)..(97): a, c, t, g, unknown or other
aaatctcacacaataaacagttggaggctcatcgttcctattcccccccccccccccccccccccccaggcagatgttatcgaggtccgacnnnnnncaacccccaaccctctacctc

SEQ ID NO: 948 - DNA, 118 bp, Artificial Sequence
  Description of Artificial Sequence: Synthetic polynucleotide
  modified_base (91)..(96): a, c, t, g, unknown or other
cccaacataacacatctacctgttggaggctcatcgttcctattccccccccccccccccccccccaggcagatgttatcgaggtccgacnnnnnnaaacttcaatactaaatcattt

SEQ ID NO: 949 - DNA, 118 bp, Artificial Sequence
  Description of Artificial Sequence: Synthetic polynucleotide
  modified_base (90)..(95): a, c, t, g, unknown or other
cactaacaaaactaattcctccgttggaggctcatcgttcctattccccccccccccccccccccaggcagatgttatcgaggtccgacnnnnnnttaaactatatacacaataacac

SEQ ID NO: 950 - DNA, 118 bp, Artificial Sequence
  Description of Artificial Sequence: Synthetic polynucleotide
  modified_base (90)..(95): a, c, t, g, unknown or other
cacccctaaatatcaaaaagttggaggctcatcgttcctattcccccccccccccccccccccccaggcagatgttatcgaggtccgacnnnnnnaaaatcaccaacaacattaattt

SEQ ID NO: 951 - DNA, 118 bp, Artificial Sequence
  Description of Artificial Sequence: Synthetic polynucleotide
  modified_base (94)..(99): a, c, t, g, unknown or other
ctccctctaaaaatcatcacgttggaggctcatcgttcctattccccccccccccccccccccccccccaggcagatgttatcgaggtccgacnnnnnnaaatccaatactccttcta

SEQ ID NO: 952 - DNA, 118 bp, Artificial Sequence
  Description of Artificial Sequence: Synthetic polynucleotide
  modified_base (89)..(94): a, c, t, g, unknown or other
acaatcctaaaaactctcagttggaggctcatcgttcctattccccccccccccccccccccccaggcagatgttatcgaggtccgacnnnnnntttataaatttcaaaatcactaat

SEQ ID NO: 953 - DNA, 118 bp, Artificial Sequence
  Description of Artificial Sequence: Synthetic polynucleotide
  modified_base (92)..(97): a, c, t, g, unknown or other
cacaattacctctcccctttcagttggaggctcatcgttcctattccccccccccccccccccccccaggcagatgttatcgaggtccgacnnnnnnacattaaaaccacttctacta

SEQ ID NO: 954 - DNA, 118 bp, Artificial Sequence
  Description of Artificial Sequence: Synthetic polynucleotide
  modified_base (87)..(92): a, c, t, g, unknown or other
accttacaacttttacctttacccagttggaggctcatcgttcctattccccccccccccccaggcagatgttatcgaggtccgacnnnnnntattccttacaactaaattaaactta

SEQ ID NO: 955 - DNA, 118 bp, Artificial Sequence
  Description of Artificial Sequence: Synthetic polynucleotide
  modified_base (89)..(94): a, c, t, g, unknown or other
caaaacccaaacctctcgttggaggctcatcgttcctattccccccccccccccccccccccccaggcagatgttatcgaggtccgacnnnnnntaaacacttcaataacattataaa

SEQ ID NO: 956 - DNA, 118 bp, Artificial Sequence
  Description of Artificial Sequence: Synthetic polynucleotide
  modified_base (90)..(95): a, c, t, g, unknown or other
cactttaccttatcaaatctgttggaggctcatcgttcctattccccccccccccccccccccccaggcagatgttatcgaggtccgacnnnnnntcctactaaaaatcatcttttat

SEQ ID NO: 957 - DNA, 118 bp, Artificial Sequence
  Description of Artificial Sequence: Synthetic polynucleotide
  modified_base (92)..(97): a, c, t, g, unknown or other
acacacacacacacacacgttggaggctcatcgttcctattccccccccccccccccccccccccccaggcagatgttatcgaggtccgacnnnnnnatacaacttcttaaacaaaaa

SEQ ID NO: 958 - DNA, 118 bp, Artificial Sequence
  Description of Artificial Sequence: Synthetic polynucleotide
  modified_base (90)..(95): a, c, t, g, unknown or other
actttatcactttttaccatatcttcaaacgttggaggctcatcgttcctattccccccccccccaggcagatgttatcgaggtccgacnnnnnnttttaaaaacattaaaatccttt

SEQ ID NO: 959 - DNA, 118 bp, Artificial Sequence
  Description of Artificial Sequence: Synthetic polynucleotide
  modified_base (89)..(94): a, c, t, g, unknown or other
ataaactatctacaaacccacataaccttatagttggaggctcatcgttcctattcccccccccaggcagatgttatcgaggtccgacnnnnnnaccccaaaatatttaatataatta

SEQ ID NO: 960 - DNA, 118 bp, Artificial Sequence
  Description of Artificial Sequence: Synthetic polynucleotide
  modified_base (85)..(90): a, c, t, g, unknown or other
accatatctacctaaaaccgttggaggctcatcgttcctattccccccccccccccccccaggcagatgttatcgaggtccgacnnnnnnaaactaccaatctatcttaaaacaataa

SEQ ID NO: 961 - DNA, 118 bp, Artificial Sequence
  Description of Artificial Sequence: Synthetic polynucleotide
  modified_base (96)..(101): a, c, t, g, unknown or other
aaaaacaaaaataatttatttacctgttggaggctcatcgttcctattcccccccccccccccccccccccaggcagatgttatcgaggtccgacnnnnnntccccatcctctcccaa

SEQ ID NO: 962 - DNA, 118 bp, Artificial Sequence
  Description of Artificial Sequence: Synthetic polynucleotide
  modified_base (93)..(98): a, c, t, g, unknown or other
acattataaaactatttacacaacgttggaggctcatcgttcctattcccccccccccccccccccccaggcagatgttatcgaggtccgacnnnnnntaaatccacaaaaccccatt

SEQ ID NO: 963 - DNA, 118 bp, Artificial Sequence
  Description of Artificial Sequence: Synthetic polynucleotide
  modified_base (89)..(94): a, c, t, g, unknown or other
tccaaaatcctcctctacctcagttggaggctcatcgttcctattcccccccccccccccccccaggcagatgttatcgaggtccgacnnnnnnaactccacaacaaactattatttt

SEQ ID NO: 964 - DNA, 118 bp, Artificial Sequence
  Description of Artificial Sequence: Synthetic polynucleotide
  modified_base (91)..(96): a, c, t, g, unknown or other
aaaaatccctataaaacccgttggaggctcatcgttcctattccccccccccccccccccccccccaggcagatgttatcgaggtccgacnnnnnntctaactaaaaataattcccct

SEQ ID NO: 965 - DNA, 118 bp, Artificial Sequence
  Description of Artificial Sequence: Synthetic polynucleotide
  modified_base (91)..(96): a, c, t, g, unknown or other
ttttaactaccttaatacaaaaagttggaggctcatcgttcctattccccccccccccccccccccaggcagatgttatcgaggtccgacnnnnnntaaaataacccctatacttctt

SEQ ID NO: 966 - DNA, 118 bp, Artificial Sequence
  Description of Artificial Sequence: Synthetic polynucleotide
  modified_base (96)..(101): a, c, t, g, unknown or other
ccctaacctcacttcacaattgttggaggctcatcgttcctattcccccccccccccccccccccccccccaggcagatgttatcgaggtccgacnnnnnnacaataacaaccaaacc

SEQ ID NO: 967 - DNA, 118 bp, Artificial Sequence
  Description of Artificial Sequence: Synthetic polynucleotide
  modified_base (90)..(95): a, c, t, g, unknown or other
atctacccaataaattctcccgttggaggctcatcgttcctattcccccccccccccccccccccaggcagatgttatcgaggtccgacnnnnnnattattccaaacaaaattcaacc

SEQ ID NO: 968 - DNA, 118 bp, Artificial Sequence
  Description of Artificial Sequence: Synthetic polynucleotide
  modified_base (96)..(101): a, c, t, g, unknown or other
ctaaaacaatacataccacctacgttggaggctcatcgttcctattcccccccccccccccccccccccccaggcagatgttatcgaggtccgacnnnnnnataacctcacaacaact

SEQ ID NO: 969 - DNA, 118 bp, Artificial Sequence
  Description of Artificial Sequence: Synthetic polynucleotide
  modified_base (91)..(96): a, c, t, g, unknown or other
acccatacaacttcctatccaccacgttggaggctcatcgttcctattccccccccccccccccccaggcagatgttatcgaggtccgacnnnnnntattttatctcaatcccaaaat

SEQ ID NO: 970 - DNA, 118 bp, Artificial Sequence
  Description of Artificial Sequence: Synthetic polynucleotide
  modified_base (90)..(95): a, c, t, g, unknown or other
ccaacctacctccctaaacgttggaggctcatcgttcctattcccccccccccccccccccccccaggcagatgttatcgaggtccgacnnnnnntcaaaaacttaataaaaccattt

SEQ ID NO: 971 - DNA, 118 bp, Artificial Sequence
  Description of Artificial Sequence: Synthetic polynucleotide
  modified_base (81)..(86): a, c, t, g, unknown or other
tcactacacccccacctcccaaagttggaggctcatcgttcctattccccccccccaggcagatgttatcgaggtccgacnnnnnnatttttaaacaacaacctcacctctaaaaact

SEQ ID NO: 972 - DNA, 118 bp, Artificial Sequence
  Description of Artificial Sequence: Synthetic polynucleotide
  modified_base (91)..(96): a, c, t, g, unknown or other
acctacacacatacaaacaaaacaaaacgttggaggctcatcgttcctattcccccccccccccccaggcagatgttatcgaggtccgacnnnnnntacataattcttacttccccaa

SEQ ID NO: 973 - DNA, 118 bp, Artificial Sequence
  Description of Artificial Sequence: Synthetic polynucleotide
  modified_base (95)..(100): a, c, t, g, unknown or other
acacacacacacacacacacacacgttggaggctcatcgttcctattcccccccccccccccccccccccaggcagatgttatcgaggtccgacnnnnnnacccctcccaactttcta

SEQ ID NO: 974 - DNA, 118 bp, Artificial Sequence
  Description of Artificial Sequence: Synthetic polynucleotide
  modified_base (90)..(95): a, c, t, g, unknown or other
tttcctaaccccaaaatcgttggaggctcatcgttcctattccccccccccccccccccccccccaggcagatgttatcgaggtccgacnnnnnnaaaaactaaaattacataaccta

SEQ ID NO: 975 - DNA, 118 bp, Artificial Sequence
  Description of Artificial Sequence: Synthetic polynucleotide
  modified_base (84)..(89): a, c, t, g, unknown or other
atccctaccctcctacaaaacgttggaggctcatcgttcctattcccccccccccccccaggcagatgttatcgaggtccgacnnnnnnaccatttaacaacattttataaatcatta

SEQ ID NO: 976 - DNA, 118 bp, Artificial Sequence
  Description of Artificial Sequence: Synthetic polynucleotide
  modified_base (91)..(96): a, c, t, g, unknown or other
caaaattatccactcacacaaccgttggaggctcatcgttcctattccccccccccccccccccccaggcagatgttatcgaggtccgacnnnnnnttttactaaaaatcaaattcac

SEQ ID NO: 977 - DNA, 118 bp, Artificial Sequence
  Description of Artificial Sequence: Synthetic polynucleotide
  modified_base (91)..(96): a, c, t, g, unknown or other
caaatactaaaccacctaaagttggaggctcatcgttcctattcccccccccccccccccccccccaggcagatgttatcgaggtccgacnnnnnntctatatctatcctctacaaaa

SEQ ID NO: 978 - DNA, 118 bp, Artificial Sequence
  Description of Artificial Sequence: Synthetic polynucleotide
  modified_base (90)..(95): a, c, t, g, unknown or other
aactccaaaaacctactgttggaggctcatcgttcctattcccccccccccccccccccccccccaggcagatgttatcgaggtccgacnnnnnncttaactcataaaaacaaaataa

SEQ ID NO: 979 - DNA, 118 bp, Artificial Sequence
  Description of Artificial Sequence: Synthetic polynucleotide
  modified_base (94)..(99): a, c, t, g, unknown or other
cttaaaacccaacactaccaacgttggaggctcatcgttcctattccccccccccccccccccccccccaggcagatgttatcgaggtccgacnnnnnntactactccacaacaaaaa

SEQ ID NO: 980 - DNA, 118 bp, Artificial Sequence
  Description of Artificial Sequence: Synthetic polynucleotide
  modified_base (83)..(88): a, c, t, g, unknown or other
accccctccccctatctttctctgttggaggctcatcgttcctattccccccccccccaggcagatgttatcgaggtccgacnnnnnnattaaaataataaaacaaatatctctttat

SEQ ID NO: 981 - DNA, 118 bp, Artificial Sequence
  Description of Artificial Sequence: Synthetic polynucleotide
  modified_base (87)..(92): a, c, t, g, unknown or other
actcatacctataatcccaacgttggaggctcatcgttcctattccccccccccccccccccaggcagatgttatcgaggtccgacnnnnnntatctttattacaacaattttataaa

SEQ ID NO: 982 - DNA, 118 bp, Artificial Sequence
  Description of Artificial Sequence: Synthetic polynucleotide
  modified_base (91)..(96): a, c, t, g, unknown or other
tcataccataacaaaatctcctgttggaggctcatcgttcctattcccccccccccccccccccccaggcagatgttatcgaggtccgacnnnnnnaaaatttaacctaactaaactt

SEQ ID NO: 983 - DNA, 118 bp, Artificial Sequence
  Description of Artificial Sequence: Synthetic polynucleotide
  modified_base (91)..(96): a, c, t, g, unknown or other
catataatatctaaacaaaacccgttggaggctcatcgttcctattccccccccccccccccccccaggcagatgttatcgaggtccgacnnnnnntaaaatccaaaaactataacca

SEQ ID NO: 984 - DNA, 118 bp, Artificial Sequence
  Description of Artificial Sequence: Synthetic polynucleotide
  modified_base (91)..(96): a, c, t, g, unknown or other
cttctatacctaactccaagttggaggctcatcgttcctattccccccccccccccccccccccccaggcagatgttatcgaggtccgacnnnnnntaaaaccaactattcattttaa

SEQ ID NO: 985 - DNA, 118 bp, Artificial Sequence
  Description of Artificial Sequence: Synthetic polynucleotide
  modified_base (93)..(98): a, c, t, g, unknown or other
acctaaatttctcctattaaataacaaaataagttggaggctcatcgttcctattcccccccccccccaggcagatgttatcgaggtccgacnnnnnntaaccaacctaccctaatat

SEQ ID NO: 986 - DNA, 118 bp, Artificial Sequence
  Description of Artificial Sequence: Synthetic polynucleotide
  modified_base (96)..(101): a, c, t, g, unknown or other
ccaataaccaattataacccgttggaggctcatcgttcctattccccccccccccccccccccccccccccaggcagatgttatcgaggtccgacnnnnnncctaccccctataaccc

SEQ ID NO: 987 - DNA, 118 bp, Artificial Sequence
  Description of Artificial Sequence: Synthetic polynucleotide
  modified_base (85)..(90): a, c, t, g, unknown or other
accctactcaactaccttcctgttggaggctcatcgttcctattccccccccccccccccaggcagatgttatcgaggtccgacnnnnnntttttatcacataaaattactataattt

SEQ ID NO: 988 - DNA, 118 bp, Artificial Sequence
  Description of Artificial Sequence: Synthetic polynucleotide
  modified_base (92)..(97): a, c, t, g, unknown or other
ccaacctccttaacctacctagttggaggctcatcgttcctattcccccccccccccccccccccccaggcagatgttatcgaggtccgacnnnnnnaaaatttacttcttccaaaaa

SEQ ID NO: 989 - DNA, 118 bp, Artificial Sequence
  Description of Artificial Sequence: Synthetic polynucleotide
  modified_base (93)..(98): a, c, t, g, unknown or other
taaactcaccaaaaatacacaacccctgttggaggctcatcgttcctattccccccccccccccccccaggcagatgttatcgaggtccgacnnnnnnaaaaatattttcacccctac

SEQ ID NO: 990 - DNA, 118 bp, Artificial Sequence
  Description of Artificial Sequence: Synthetic polynucleotide
  modified_base (86)..(91): a, c, t, g, unknown or other
accccaaattccccttcctaccgttggaggctcatcgttcctattccccccccccccccccaggcagatgttatcgaggtccgacnnnnnnaacttcaaatattcataataccttaca

SEQ ID NO: 991 - DNA, 118 bp, Artificial Sequence
  Description of Artificial Sequence: Synthetic polynucleotide
  modified_base (91)..(96): a, c, t, g, unknown or other
cctataatcccaacactttaaagttggaggctcatcgttcctattcccccccccccccccccccccaggcagatgttatcgaggtccgacnnnnnntcccaaaatactaaaaatacaa

SEQ ID NO: 992 - DNA, 118 bp, Artificial Sequence
  Description of Artificial Sequence: Synthetic polynucleotide
  modified_base (92)..(97): a, c, t, g, unknown or other
cattttaaccaaaattaataaccagttggaggctcatcgttcctattccccccccccccccccccccaggcagatgttatcgaggtccgacnnnnnnaaaatacccaaaaattaactt

SEQ ID NO: 993 - DNA, 118 bp, Artificial Sequence
  Description of Artificial Sequence: Synthetic polynucleotide
  modified_base (88)..(93): a, c, t, g, unknown or other
acctcataaaacctccatccctaagttggaggctcatcgttcctattccccccccccccccccaggcagatgttatcgaggtccgacnnnnnnttcatttaacacatatttataaaaa

SEQ ID NO: 994 - DNA, 118 bp, Artificial Sequence
  Description of Artificial Sequence: Synthetic polynucleotide
  modified_base (94)..(99): a, c, t, g, unknown or other
actaatcacccctctatgttggaggctcatcgttcctattcccccccccccccccccccccccccccccaggcagatgttatcgaggtccgacnnnnnntctttattccctcttaaca

SEQ ID NO: 995 - DNA, 118 bp, Artificial Sequence
  Description of Artificial Sequence: Synthetic polynucleotide
  modified_base (88)..(93): a, c, t, g, unknown or other
acccctacctcccatactcaccttcaagttggaggctcatcgttcctattcccccccccccccaggcagatgttatcgaggtccgacnnnnnnaaaccccaacaaaccaaactaccca

SEQ ID NO: 996 - DNA, 118 bp, Artificial Sequence
  Description of Artificial Sequence: Synthetic polynucleotide
  modified_base (89)..(94): a, c, t, g, unknown or other
acttaaccaaaacataaaatttatatccgttggaggctcatcgttcctattcccccccccccccaggcagatgttatcgaggtccgacnnnnnntttaacctttattacaaactataa

SEQ ID NO: 997 - DNA, 118 bp, Artificial Sequence
  Description of Artificial Sequence: Synthetic polynucleotide
  modified_base (91)..(96): a, c, t, g, unknown or other
atctctccctcctcacgttggaggctcatcgttcctattcccccccccccccccccccccccccccaggcagatgttatcgaggtccgacnnnnnnacaatctataaataacctttct

SEQ ID NO: 998 - DNA, 118 bp, Artificial Sequence
  Description of Artificial Sequence: Synthetic polynucleotide
  modified_base (92)..(97): a, c, t, g, unknown or other
ccaaatataataacctaaaaacaacgttggaggctcatcgttcctattcccccccccccccccccccaggcagatgttatcgaggtccgacnnnnnnaactaaaaacaaaacaatcct

SEQ ID NO: 999 - DNA, 118 bp, Artificial Sequence
  Description of Artificial Sequence: Synthetic polynucleotide
  modified_base (95)..(100): a, c, t, g, unknown or other
aaaaacccctctaaacaacctgttggaggctcatcgttcctattccccccccccccccccccccccccccaggcagatgttatcgaggtccgacnnnnnnaacacatcaaaacaacaa

SEQ ID NO: 1000 - DNA, 118 bp, Artificial Sequence
  Description of Artificial Sequence: Synthetic polynucleotide
  modified_base (94)..(99): a, c, t, g, unknown or other
aaaaactcctaccactatccgttggaggctcatcgttcctattccccccccccccccccccccccccccaggcagatgttatcgaggtccgacnnnnnnactcaaaaccaaaaacctt

SEQ ID NO: 1001 - DNA, 118 bp, Artificial Sequence
  Description of Artificial Sequence: Synthetic polynucleotide
  modified_base (93)..(98): a, c, t, g, unknown or other
acaacctaaaatcacaaaacaaagttggaggctcatcgttcctattccccccccccccccccccccccaggcagatgttatcgaggtccgacnnnnnnaaaacccaaaaacttttaaa

SEQ ID NO: 1002 - DNA, 118 bp, Artificial Sequence
  Description of Artificial Sequence: Synthetic polynucleotide
  modified_base (91)..(96): a, c, t, g, unknown or other
acctaaacaccaaaatattcctactcacccgttggaggctcatcgttcctattcccccccccccccaggcagatgttatcgaggtccgacnnnnnnaatccttttcttcattataaaa

SEQ ID NO: 1003 - DNA, 118 bp, Artificial Sequence
  Description of Artificial Sequence: Synthetic polynucleotide
  modified_base (91)..(96): a, c, t, g, unknown or other
tcccaaaccaaataactccgttggaggctcatcgttcctattccccccccccccccccccccccccaggcagatgttatcgaggtccgacnnnnnnctacaaataaactacacttaaa

SEQ ID NO: 1004 - DNA, 118 bp, Artificial Sequence
  Description of Artificial Sequence: Synthetic polynucleotide
  modified_base (94)..(99): a, c, t, g, unknown or other
aactaaacccacattatctagttggaggctcatcgttcctattccccccccccccccccccccccccccaggcagatgttatcgaggtccgacnnnnnnaacaaactcaaaacaaaac

SEQ ID NO: 1005 - DNA, 118 bp, Artificial Sequence
  Description of Artificial Sequence: Synthetic polynucleotide
  modified_base (92)..(97): a, c, t, g, unknown or other
tctacctcctcctactactactaacaagttggaggctcatcgttcctattcccccccccccccccccaggcagatgttatcgaggtccgacnnnnnnaacaaactaaaactatacctt

SEQ ID NO: 1006 - DNA, 118 bp, Artificial Sequence
  Description of Artificial Sequence: Synthetic polynucleotide
  modified_base (93)..(98): a, c, t, g, unknown or other
accaccactacatcccgttggaggctcatcgttcctattcccccccccccccccccccccccccccccaggcagatgttatcgaggtccgacnnnnnntaactctcaactacctacct

SEQ ID NO: 1007 - DNA, 118 bp, Artificial Sequence
  Description of Artificial Sequence: Synthetic polynucleotide
  modified_base (89)..(94): a, c, t, g, unknown or other
acaaaaacccacttaaatataacctaacccctgttggaggctcatcgttcctattcccccccccaggcagatgttatcgaggtccgacnnnnnnaaaaacacctataaataatctaaa

SEQ ID NO: 1008 - DNA, 118 bp, Artificial Sequence
  Description of Artificial Sequence: Synthetic polynucleotide
  modified_base (88)..(93): a, c, t, g, unknown or other
acaccaaaacaaccacgttggaggctcatcgttcctattccccccccccccccccccccccccaggcagatgttatcgaggtccgacnnnnnntaacaacacccctactaacaaacaa

SEQ ID NO: 1009 - DNA, 118 bp, Artificial Sequence
  Description of Artificial Sequence: Synthetic polynucleotide
  modified_base (97)..(102): a, c, t, g, unknown or other
tactacaatttcacaacacaccgttggaggctcatcgttcctattcccccccccccccccccccccccccccaggcagatgttatcgaggtccgacnnnnnnatttccacatccacaa

SEQ ID NO: 1010 - DNA, 118 bp, Artificial Sequence
  Description of Artificial Sequence: Synthetic polynucleotide
  modified_base (95)..(100): a, c, t, g, unknown or other
acctctcaacccaaacgttggaggctcatcgttcctattcccccccccccccccccccccccccccccccaggcagatgttatcgaggtccgacnnnnnnttctcaacctccctccca

SEQ ID NO: 1011 - DNA, 118 bp, Artificial Sequence
  Description of Artificial Sequence: Synthetic polynucleotide
  modified_base (87)..(92): a, c, t, g, unknown or other
acaaccactaaatcaaatctaaccaaataccgttggaggctcatcgttcctattccccccccaggcagatgttatcgaggtccgacnnnnnnataattcccattatatttattttaaa

SEQ ID NO: 1012 - DNA, 118 bp, Artificial Sequence
  Description of Artificial Sequence: Synthetic polynucleotide
  modified_base (96)..(101): a, c, t, g, unknown or other
actaactccaataatttatactgttggaggctcatcgttcctattccccccccccccccccccccccccccaggcagatgttatcgaggtccgacnnnnnnttacccacctcccaccc

SEQ ID NO: 1013 - DNA, 118 bp, Artificial Sequence
  Description of Artificial Sequence: Synthetic polynucleotide
  modified_base (94)..(99): a, c, t, g, unknown or other
actccaaacctaccctgttggaggctcatcgttcctattccccccccccccccccccccccccccccccaggcagatgttatcgaggtccgacnnnnnnacctacttccttacaaaac

SEQ ID NO: 1014 - DNA, 118 bp, Artificial Sequence
  Description of Artificial Sequence: Synthetic polynucleotide
  modified_base (90)..(95): a, c, t, g, unknown or other
tctaaaccctaacccactacctaatttacgttggaggctcatcgttcctattcccccccccccccaggcagatgttatcgaggtccgacnnnnnncaaatccccaaactaacacaaac

SEQ ID NO: 1015 - DNA, 118 bp, Artificial Sequence
  Description of Artificial Sequence: Synthetic polynucleotide
  modified_base (94)..(99): a, c, t, g, unknown or other
aaactacttttaaaacaaatctgttggaggctcatcgttcctattccccccccccccccccccccccccaggcagatgttatcgaggtccgacnnnnnntcactaaatccaacaaaaa

SEQ ID NO: 1016 - DNA, 118 bp, Artificial Sequence
  Description of Artificial Sequence: Synthetic polynucleotide
  modified_base (91)..(96): a, c, t, g, unknown or other
acactaactttcaaatacatagttggaggctcatcgttcctattccccccccccccccccccccccaggcagatgttatcgaggtccgacnnnnnntccaaaatacaaacaatttata

SEQ ID NO: 1017 - DNA, 118 bp, Artificial Sequence
  Description of Artificial Sequence: Synthetic polynucleotide
  modified_base (88)..(93): a, c, t, g, unknown or other
tcctctattaaaacacctcgttggaggctcatcgttcctattcccccccccccccccccccccaggcagatgttatcgaggtccgacnnnnnntcaaaacataaactacaaaattaca

SEQ ID NO: 1018 - DNA, 118 bp, Artificial Sequence
  Description of Artificial Sequence: Synthetic polynucleotide
  modified_base (97)..(102): a, c, t, g, unknown or other
accctaaaacaccaacgttggaggctcatcgttcctattcccccccccccccccccccccccccccccccccaggcagatgttatcgaggtccgacnnnnnnaacctaacctccttct

SEQ ID NO: 1019 - DNA, 118 bp, Artificial Sequence
  Description of Artificial Sequence: Synthetic polynucleotide
  modified_base (88)..(93): a, c, t, g, unknown or other
ccccctcttatctacaagttggaggctcatcgttcctattcccccccccccccccccccccccaggcagatgttatcgaggtccgacnnnnnntttaaacacaaacaatacaatactt

SEQ ID NO: 1020 - DNA, 118 bp, Artificial Sequence
  Description of Artificial Sequence: Synthetic polynucleotide
  modified_base (92)..(97): a, c, t, g, unknown or other
acacacaaatcacctaactactccttcagttggaggctcatcgttcctattccccccccccccccccaggcagatgttatcgaggtccgacnnnnnntcctaacaaaaatctacaaat

SEQ ID NO: 1021 - DNA, 118 bp, Artificial Sequence
  Description of Artificial Sequence: Synthetic polynucleotide
  modified_base (93)..(98): a, c, t, g, unknown or other
acccaaaacaacaaccaaaaccccatacagttggaggctcatcgttcctattccccccccccccccccaggcagatgttatcgaggtccgacnnnnnnaaacatccaatacctacaaa

SEQ ID NO: 1022 - DNA, 118 bp, Artificial Sequence
  Description of Artificial Sequence: Synthetic polynucleotide
  modified_base (90)..(95): a, c, t, g, unknown or other
tttctttttacacaacaaccttgttggaggctcatcgttcctattccccccccccccccccccccaggcagatgttatcgaggtccgacnnnnnntaaaacaaaacaacaaataaata

SEQ ID NO: 1023 - DNA, 118 bp, Artificial Sequence
  Description of Artificial Sequence: Synthetic polynucleotide
  modified_base (88)..(93): a, c, t, g, unknown or other
acaacatttaatattaaccacaactctacaagttggaggctcatcgttcctattcccccccccaggcagatgttatcgaggtccgacnnnnnnttttcttatccctcaatcctactta

SEQ ID NO: 1024 - DNA, 118 bp, Artificial Sequence
  Description of Artificial Sequence: Synthetic polynucleotide
  modified_base (89)..(94): a, c, t, g, unknown or other
acaaaaccttcttcaaaagttggaggctcatcgttcctattcccccccccccccccccccccccaggcagatgttatcgaggtccgacnnnnnntataaacttaaaccaaaccaaaaa

SEQ ID NO: 1025 - DNA, 118 bp, Artificial Sequence
  Description of Artificial Sequence: Synthetic polynucleotide
  modified_base (92)..(97): a, c, t, g, unknown or other
acctctaacttctacaacgttggaggctcatcgttcctattccccccccccccccccccccccccccaggcagatgttatcgaggtccgacnnnnnntaactcatactaaaaattcct

SEQ ID NO: 1026 - DNA, 118 bp, Artificial Sequence
  Description of Artificial Sequence: Synthetic polynucleotide
  modified_base (88)..(93): a, c, t, g, unknown or other
attcaaataattctcctacctcaaccccgttggaggctcatcgttcctattccccccccccccaggcagatgttatcgaggtccgacnnnnnnttttatttatttcttttaaaacaaa

SEQ ID NO: 1027 - DNA, 118 bp, Artificial Sequence
  Description of Artificial Sequence: Synthetic polynucleotide
  modified_base (93)..(98): a, c, t, g, unknown or other
ccactaccaacccaactccagttggaggctcatcgttcctattcccccccccccccccccccccccccaggcagatgttatcgaggtccgacnnnnnnaaaaacacaaaaacctaaat

SEQ ID NO: 1028 - DNA, 118 bp, Artificial Sequence
  Description of Artificial Sequence: Synthetic polynucleotide
  modified_base (96)..(101): a, c, t, g, unknown or other
aattcttctaatcacccaaaatgttggaggctcatcgttcctattccccccccccccccccccccccccccaggcagatgttatcgaggtccgacnnnnnntcacaacaacaacacaa

SEQ ID NO: 1029 - DNA, 118 bp, Artificial Sequence
  Description of Artificial Sequence: Synthetic polynucleotide
  modified_base (96)..(101): a, c, t, g, unknown or other
aactaaacatttctaactaaaatccctcctcagttggaggctcatcgttcctattccccccccccccccccaggcagatgttatcgaggtccgacnnnnnnaaaaaccaccactcaaa

SEQ ID NO: 1030 - DNA, 118 bp, Artificial Sequence
  Description of Artificial Sequence: Synthetic polynucleotide
  modified_base (87)..(92): a, c, t, g, unknown or other
acccttcaacttcctacccactatcttcagttggaggctcatcgttcctattccccccccccaggcagatgttatcgaggtccgacnnnnnnaaccccttacctcaatcctctaccct

SEQ ID NO: 1031 - DNA, 118 bp, Artificial Sequence
  Description of Artificial Sequence: Synthetic polynucleotide
  modified_base (97)..(102): a, c, t, g, unknown or other
ctaaaccatttccaaaactcgttggaggctcatcgttcctattcccccccccccccccccccccccccccccaggcagatgttatcgaggtccgacnnnnnnaccccacaaaccacct

SEQ ID NO: 1032 - DNA, 118 bp, Artificial Sequence
  Description of Artificial Sequence: Synthetic polynucleotide
  modified_base (94)..(99): a, c, t, g, unknown or other
tcctatcctttcttccaataaatacgttggaggctcatcgttcctattcccccccccccccccccccccaggcagatgttatcgaggtccgacnnnnnnaaacaccacccataaaatt

SEQ ID NO: 1033 - DNA, 118 bp, Artificial Sequence
  Description of Artificial Sequence: Synthetic polynucleotide
  modified_base (97)..(102): a, c, t, g, unknown or other
cctaccaaaccaaacaaaataataagttggaggctcatcgttcctattccccccccccccccccccccccccaggcagatgttatcgaggtccgacnnnnnnttctccctccactaaa

SEQ ID NO: 1034 - DNA, 118 bp, Artificial Sequence
  Description of Artificial Sequence: Synthetic polynucleotide
  modified_base (94)..(99): a, c, t, g, unknown or other
ccaaaacaaccaatcactcaagttggaggctcatcgttcctattcccccccccccccccccccccccccaggcagatgttatcgaggtccgacnnnnnnacaaaaacaaacaaaatcc

SEQ ID NO: 1035 - DNA, 118 bp, Artificial Sequence
  Description of Artificial Sequence: Synthetic polynucleotide
  modified_base (94)..(99): a, c, t, g, unknown or other
taaaatcaataaaacccataaacaaaaccaaagttggaggctcatcgttcctattccccccccccccccaggcagatgttatcgaggtccgacnnnnnnttaatcaacctctcaaccc

SEQ ID NO: 1036 - DNA, 118 bp, Artificial Sequence
  Description of Artificial Sequence: Synthetic polynucleotide
  modified_base (92)..(97): a, c, t, g, unknown or other
cttccactaataaacaccagttggaggctcatcgttcctattcccccccccccccccccccccccccaggcagatgttatcgaggtccgacnnnnnntaaaactctctaaaacccaaa

SEQ ID NO: 1037 - DNA, 118 bp, Artificial Sequence
  Description of Artificial Sequence: Synthetic polynucleotide
  modified_base (82)..(87): a, c, t, g, unknown or other
acttctcattcctaaccaaaacccaaattcccgttggaggctcatcgttcctattccaggcagatgttatcgaggtccgacnnnnnnactctttcctctccttttactccctaaattt

SEQ ID NO: 1038 - DNA, 118 bp, Artificial Sequence
  Description of Artificial Sequence: Synthetic polynucleotide
  modified_base (92)..(97): a, c, t, g, unknown or other
ctacactaaacccaacctacgttggaggctcatcgttcctattccccccccccccccccccccccccaggcagatgttatcgaggtccgacnnnnnncccaaaataaaacaaataacc

SEQ ID NO: 1039 - DNA, 118 bp, Artificial Sequence
  Description of Artificial Sequence: Synthetic polynucleotide
  modified_base (94)..(99): a, c, t, g, unknown or other
ccctaaacctctataaaataactgttggaggctcatcgttcctattcccccccccccccccccccccccaggcagatgttatcgaggtccgacnnnnnnttcaccactaaaaatttct

SEQ ID NO: 1040 - DNA, 118 bp, Artificial Sequence
  Description of Artificial Sequence: Synthetic polynucleotide
  modified_base (93)..(98): a, c, t, g, unknown or other
ctaactaacataactacccacgttggaggctcatcgttcctattccccccccccccccccccccccccaggcagatgttatcgaggtccgacnnnnnnaaacaaatttaacaacctct

SEQ ID NO: 1041 - DNA, 118 bp, Artificial Sequence
  Description of Artificial Sequence: Synthetic polynucleotide
  modified_base (94)..(99): a, c, t, g, unknown or other
ctctttcctttctaaaaattccgttggaggctcatcgttcctattccccccccccccccccccccccccaggcagatgttatcgaggtccgacnnnnnnaactacaacaccccaataa

SEQ ID NO: 1042 - DNA, 118 bp, Artificial Sequence
  Description of Artificial Sequence: Synthetic polynucleotide
  modified_base (89)..(94): a, c, t, g, unknown or other
actcccccacccctacaatgttggaggctcatcgttcctattccccccccccccccccccccccaggcagatgttatcgaggtccgacnnnnnnatatcaaaaacaaaatacaaatat

SEQ ID NO: 1043 - DNA, 118 bp, Artificial Sequence
  Description of Artificial Sequence: Synthetic polynucleotide
  modified_base (88)..(93): a, c, t, g, unknown or other
attttccaaaataacccaaaatacgttggaggctcatcgttcctattccccccccccccccccaggcagatgttatcgaggtccgacnnnnnnataactcattacatattctatttat

SEQ ID NO: 1044 - DNA, 118 bp, Artificial Sequence
  Description of Artificial Sequence: Synthetic polynucleotide
  modified_base (91)..(96): a, c, t, g, unknown or other
caacaacatttaaaacaaaccgttggaggctcatcgttcctattccccccccccccccccccccccaggcagatgttatcgaggtccgacnnnnnntacaccctaaaaattcttaaaa

SEQ ID NO: 1045 - DNA, 118 bp, Artificial Sequence
  Description of Artificial Sequence: Synthetic polynucleotide
  modified_base (89)..(94): a, c, t, g, unknown or other
atccacacccctcttacctaaatctctttccgttggaggctcatcgttcctattccccccccccaggcagatgttatcgaggtccgacnnnnnnaaaacatctccacattctacccct

SEQ ID NO: 1046 - DNA, 118 bp, Artificial Sequence
  Description of Artificial Sequence: Synthetic polynucleotide
  modified_base (89)..(94): a, c, t, g, unknown or other
ccccaaaaccattattccaacatcttttctctgttggaggctcatcgttcctattcccccccccaggcagatgttatcgaggtccgacnnnnnntcccaaattaactcatccattatt

SEQ ID NO: 1047 - DNA, 118 bp, Artificial Sequence
  Description of Artificial Sequence: Synthetic polynucleotide
  modified_base (97)..(102): a, c, t, g, unknown or other
acaccctctcctatccaacgttggaggctcatcgttcctattccccccccccccccccccccccccccccccaggcagatgttatcgaggtccgacnnnnnnactaaccccaaaccca

SEQ ID NO: 1048 - DNA, 118 bp, Artificial Sequence
  Description of Artificial Sequence: Synthetic polynucleotide
  modified_base (93)..(98): a, c, t, g, unknown or other
aacttacttactaaatccaatgttggaggctcatcgttcctattccccccccccccccccccccccccaggcagatgttatcgaggtccgacnnnnnnaaaccctctaacatataacc

SEQ ID NO: 1049 - DNA, 118 bp, Artificial Sequence
  Description of Artificial Sequence: Synthetic polynucleotide
  modified_base (93)..(98): a, c, t, g, unknown or other
ctaatactaattattccaacaataagttggaggctcatcgttcctattccccccccccccccccccccaggcagatgttatcgaggtccgacnnnnnnaaaaactcactatcctaaat

SEQ ID NO: 1050 - DNA, 118 bp, Artificial Sequence
  Description of Artificial Sequence: Synthetic polynucleotide
  modified_base (85)..(90): a, c, t, g, unknown or other
tctatcttaccctcctccaagttggaggctcatcgttcctattcccccccccccccccccaggcagatgttatcgaggtccgacnnnnnntccactaaaactttccaaatatttactt

SEQ ID NO: 1051 - DNA, 118 bp, Artificial Sequence
  Description of Artificial Sequence: Synthetic polynucleotide
  modified_base (88)..(93): a, c, t, g, unknown or other
catcttaaaaccccacccgttggaggctcatcgttcctattccccccccccccccccccccccaggcagatgttatcgaggtccgacnnnnnnttttaatataacccccaaatccttt

SEQ ID NO: 1052 - DNA, 118 bp, Artificial Sequence
  Description of Artificial Sequence: Synthetic polynucleotide
  modified_base (92)..(97): a, c, t, g, unknown or other
ccaaatacctacatcaaaactgttggaggctcatcgttcctattcccccccccccccccccccccccaggcagatgttatcgaggtccgacnnnnnnaaaaactttaacataatcctc

SEQ ID NO: 1053 - DNA, 118 bp, Artificial Sequence
  Description of Artificial Sequence: Synthetic polynucleotide
  modified_base (96)..(101): a, c, t, g, unknown or other
attaaaatattaaattaatcatcaccgttggaggctcatcgttcctattccccccccccccccccccccccaggcagatgttatcgaggtccgacnnnnnnaaccttccctattttcc

SEQ ID NO: 1054 - DNA, 118 bp, Artificial Sequence
  Description of Artificial Sequence: Synthetic polynucleotide
  modified_base (94)..(99): a, c, t, g, unknown or other
aaataaaactcctcttactcgttggaggctcatcgttcctattccccccccccccccccccccccccccaggcagatgttatcgaggtccgacnnnnnnacttctttcaaattctcaa

SEQ ID NO: 1055 - DNA, 118 bp, Artificial Sequence
  Description of Artificial Sequence: Synthetic polynucleotide
  modified_base (90)..(95): a, c, t, g, unknown or other
aaatcaaactcaccctactgttggaggctcatcgttcctattcccccccccccccccccccccccaggcagatgttatcgaggtccgacnnnnnnactacattaaatacatacaaatt

SEQ ID NO: 1056 - DNA, 118 bp, Artificial Sequence
  Description of Artificial Sequence: Synthetic polynucleotide
  modified_base (89)..(94): a, c, t, g, unknown or other
cacttaattaattccaaaccgttggaggctcatcgttcctattcccccccccccccccccccccaggcagatgttatcgaggtccgacnnnnnnacatttttataatcaaaactattt

SEQ ID NO: 1057 - DNA, 118 bp, Artificial Sequence
  Description of Artificial Sequence: Synthetic polynucleotide
  modified_base (91)..(96): a, c, t, g, unknown or other
cacaaaactaactttcaccaagttggaggctcatcgttcctattccccccccccccccccccccccaggcagatgttatcgaggtccgacnnnnnnaaaaacattcttctatacaaaa

SEQ ID NO: 1058 - DNA, 118 bp, Artificial Sequence
  Description of Artificial Sequence: Synthetic polynucleotide
  modified_base (91)..(96): a, c, t, g, unknown or other
cacccctaaatatcaaaaagttggaggctcatcgttcctattccccccccccccccccccccccccaggcagatgttatcgaggtccgacnnnnnnaaatcaccaacaacattaattt

SEQ ID NO: 1059 - DNA, 118 bp, Artificial Sequence
  Description of Artificial Sequence: Synthetic polynucleotide
  modified_base (96)..(101): a, c, t, g, unknown or other
aaataaaaaccacctaaactcaacgttggaggctcatcgttcctattccccccccccccccccccccccccaggcagatgttatcgaggtccgacnnnnnnaacaaaatccccaacct

SEQ ID NO: 1060 - DNA, 118 bp, Artificial Sequence
  Description of Artificial Sequence: Synthetic polynucleotide
  modified_base (94)..(99): a, c, t, g, unknown or other
ctcttccctatccctctaccagttggaggctcatcgttcctattcccccccccccccccccccccccccaggcagatgttatcgaggtccgacnnnnnnactaccaacctaaactttt

SEQ ID NO: 1061 - DNA, 118 bp, Artificial Sequence
  Description of Artificial Sequence: Synthetic polynucleotide
  modified_base (95)..(100): a, c, t, g, unknown or other
ccctacaacccaaaacaacaagttggaggctcatcgttcctattccccccccccccccccccccccccccaggcagatgttatcgaggtccgacnnnnnntctctaaaactcaacctt

SEQ ID NO: 1062 - DNA, 118 bp, Artificial Sequence
  Description of Artificial Sequence: Synthetic polynucleotide
  modified_base (92)..(97): a, c, t, g, unknown or other
caacctaaactaataccctaaagttggaggctcatcgttcctattccccccccccccccccccccccaggcagatgttatcgaggtccgacnnnnnntacctaaaactaaaatctacc

SEQ ID NO: 1063 - DNA, 118 bp, Artificial Sequence
  Description of Artificial Sequence: Synthetic polynucleotide
  modified_base (86)..(91): a, c, t, g, unknown or other
ataaccttaataatactcctctactaccagttggaggctcatcgttcctattcccccccccaggcagatgttatcgaggtccgacnnnnnnacattaaaaatactattaataaaattt

SEQ ID NO: 1064 - DNA, 118 bp, Artificial Sequence
  Description of Artificial Sequence: Synthetic polynucleotide
  modified_base (96)..(101): a, c, t, g, unknown or other
cctcaaactactatcaaaataaaaagttggaggctcatcgttcctattcccccccccccccccccccccccaggcagatgttatcgaggtccgacnnnnnnctcacttccacaactca

SEQ ID NO: 1065 - DNA, 118 bp, Artificial Sequence
  Description of Artificial Sequence: Synthetic polynucleotide
  modified_base (91)..(96): a, c, t, g, unknown or other
accatactaaacaactaactttcctcccgttggaggctcatcgttcctattcccccccccccccccaggcagatgttatcgaggtccgacnnnnnncactaacttccttaaaaataat

SEQ ID NO: 1066 - DNA, 118 bp, Artificial Sequence
  Description of Artificial Sequence: Synthetic polynucleotide
  modified_base (95)..(100): a, c, t, g, unknown or other
aaaactaacactccaaaaagttggaggctcatcgttcctattccccccccccccccccccccccccccccaggcagatgttatcgaggtccgacnnnnnnaaaaacctcaacttcttc

SEQ ID NO: 1067 - DNA, 118 bp, Artificial Sequence
  Description of Artificial Sequence: Synthetic polynucleotide
  modified_base (86)..(91): a, c, t, g, unknown or other
tttccacatcctaccactacctcgttggaggctcatcgttcctattcccccccccccccccaggcagatgttatcgaggtccgacnnnnnnatttctctaaacaaccaactaatataa

SEQ ID NO: 1068 - DNA, 118 bp, Artificial Sequence
  Description of Artificial Sequence: Synthetic polynucleotide
  modified_base (93)..(98): a, c, t, g, unknown or other
ctcaaacaaatcacttaaaccagttggaggctcatcgttcctattcccccccccccccccccccccccaggcagatgttatcgaggtccgacnnnnnnaaaaattaaccccttctcta

SEQ ID NO: 1069 - DNA, 118 bp, Artificial Sequence
  Description of Artificial Sequence: Synthetic polynucleotide
  modified_base (94)..(99): a, c, t, g, unknown or other
aataaatatatatacttatttaacaaacgttggaggctcatcgttcctattccccccccccccccccccaggcagatgttatcgaggtccgacnnnnnntcttcttccaaacaaaaca

SEQ ID NO: 1070 - DNA, 118 bp, Artificial Sequence
  Description of Artificial Sequence: Synthetic polynucleotide
  modified_base (90)..(95): a, c, t, g, unknown or other
aaactacaaacacaaccgttggaggctcatcgttcctattcccccccccccccccccccccccccaggcagatgttatcgaggtccgacnnnnnnaaatatctctaatcacaaaaatt

SEQ ID NO: 1071 - DNA, 118 bp, Artificial Sequence
  Description of Artificial Sequence: Synthetic polynucleotide
  modified_base (88)..(93): a, c, t, g, unknown or other
actcctaacttcaaaacttgttggaggctcatcgttcctattcccccccccccccccccccccaggcagatgttatcgaggtccgacnnnnnntccacttaattacaataataaacta

SEQ ID NO: 1072 - DNA, 118 bp, Artificial Sequence
  Description of Artificial Sequence: Synthetic polynucleotide
  modified_base (92)..(97): a, c, t, g, unknown or other
acttcccctcccaaatagttggaggctcatcgttcctattcccccccccccccccccccccccccccaggcagatgttatcgaggtccgacnnnnnntaacatctaattcaaaactct

SEQ ID NO: 1073 - DNA, 118 bp, Artificial Sequence
  Description of Artificial Sequence: Synthetic polynucleotide
  modified_base (89)..(94): a, c, t, g, unknown or other
ttataattataccattactttttcccaaacttgttggaggctcatcgttcctattcccccccccaggcagatgttatcgaggtccgacnnnnnntaaaccacatacaccctcctatca

SEQ ID NO: 1074 - DNA, 118 bp, Artificial Sequence
  Description of Artificial Sequence: Synthetic polynucleotide
  modified_base (92)..(97): a, c, t, g, unknown or other
atactacaaaacaaaaacacagttggaggctcatcgttcctattcccccccccccccccccccccccaggcagatgttatcgaggtccgacnnnnnntttacaatttaaaacacacaa

SEQ ID NO: 1075 - DNA, 118 bp, Artificial Sequence
  Description of Artificial Sequence: Synthetic polynucleotide
  modified_base (91)..(96): a, c, t, g, unknown or other
accatctcctcttaaaaacaatccctatctccgttggaggctcatcgttcctattcccccccccccaggcagatgttatcgaggtccgacnnnnnnaaaataacctcaccaaaccctt

SEQ ID NO: 1076 - DNA, 118 bp, Artificial Sequence
  Description of Artificial Sequence: Synthetic polynucleotide
  modified_base (92)..(97): a, c, t, g, unknown or other
aaccacattaaaaatcccgttggaggctcatcgttcctattccccccccccccccccccccccccccaggcagatgttatcgaggtccgacnnnnnnctccaaatttaatacaccaaa

SEQ ID NO: 1077 - DNA, 118 bp, Artificial Sequence
  Description of Artificial Sequence: Synthetic polynucleotide
  modified_base (89)..(94): a, c, t, g, unknown or other
acctctaactcaatatatcagttggaggctcatcgttcctattcccccccccccccccccccccaggcagatgttatcgaggtccgacnnnnnntaatttctttttctacaacaaaaa

SEQ ID NO: 1078 - DNA, 118 bp, Artificial Sequence
  Description of Artificial Sequence: Synthetic polynucleotide
  modified_base (96)..(101): a, c, t, g, unknown or other
aattcaatcttcacctcccaatgttggaggctcatcgttcctattccccccccccccccccccccccccccaggcagatgttatcgaggtccgacnnnnnnaaaactaacccaaacca

SEQ ID NO: 1079 - DNA, 118 bp, Artificial Sequence
  Description of Artificial Sequence: Synthetic polynucleotide
  modified_base (83)..(88): a, c, t, g, unknown or other
acccaacccccacctctataccctaacttagttggaggctcatcgttcctattcccccaggcagatgttatcgaggtccgacnnnnnnattttattccctaattttaattttcttatt

SEQ ID NO: 1080 - DNA, 118 bp, Artificial Sequence
  Description of Artificial Sequence: Synthetic polynucleotide
  modified_base (95)..(100): a, c, t, g, unknown or other
taaataaaactacctcaaatatccctgttggaggctcatcgttcctattcccccccccccccccccccccaggcagatgttatcgaggtccgacnnnnnncataaccaaaacctaacc

SEQ ID NO: 1081 - DNA, 118 bp, Artificial Sequence
  Description of Artificial Sequence: Synthetic polynucleotide
  modified_base (90)..(95): a, c, t, g, unknown or other
acttaactcaaacaacaacgttggaggctcatcgttcctattcccccccccccccccccccccccaggcagatgttatcgaggtccgacnnnnnnacaaactcttaaataactcattt

SEQ ID NO: 1082 - DNA, 118 bp, Artificial Sequence
  Description of Artificial Sequence: Synthetic polynucleotide
  modified_base (87)..(92): a, c, t, g, unknown or other
actttaaccctttattcccacttaaagttggaggctcatcgttcctattcccccccccccccaggcagatgttatcgaggtccgacnnnnnnaaacaattacataaacacaacctcct

SEQ ID NO: 1083 - DNA, 118 bp, Artificial Sequence
  Description of Artificial Sequence: Synthetic polynucleotide
  modified_base (90)..(95): a, c, t, g, unknown or other
caaaaattcaaaaccaacctagttggaggctcatcgttcctattcccccccccccccccccccccaggcagatgttatcgaggtccgacnnnnnnaaaaacaaaaacctatatttaac

SEQ ID NO: 1084 - DNA, 118 bp, Artificial Sequence
  Description of Artificial Sequence: Synthetic polynucleotide
  modified_base (88)..(93): a, c, t, g, unknown or other
acctatcatataaataccaacctcaagttggaggctcatcgttcctattccccccccccccccaggcagatgttatcgaggtccgacnnnnnntataattaacaaacaaaataccttt

SEQ ID NO: 1085 - DNA, 118 bp, Artificial Sequence
  Description of Artificial Sequence: Synthetic polynucleotide
  modified_base (89)..(94): a, c, t, g, unknown or other
cccctaccttaaaacctgttggaggctcatcgttcctattccccccccccccccccccccccccaggcagatgttatcgaggtccgacnnnnnnatttttctaaaaattaaaaactct

SEQ ID NO: 1086 - DNA, 118 bp, Artificial Sequence
  Description of Artificial Sequence: Synthetic polynucleotide
  modified_base (92)..(97): a, c, t, g, unknown or other
tcctcctatctcctattcctaaaccgttggaggctcatcgttcctattcccccccccccccccccccaggcagatgttatcgaggtccgacnnnnnntttctctcctaataacaaaaa

SEQ ID NO: 1087 - DNA, 118 bp, Artificial Sequence
  Description of Artificial Sequence: Synthetic polynucleotide
  modified_base (97)..(102): a, c, t, g, unknown or other
accacccccaatcccaatgttggaggctcatcgttcctattcccccccccccccccccccccccccccccccaggcagatgttatcgaggtccgacnnnnnnccaaacccaatccccc

SEQ ID NO: 1088 - DNA, 118 bp, Artificial Sequence
  Description of Artificial Sequence: Synthetic polynucleotide
  modified_base (94)..(99): a, c, t, g, unknown or other
cctcctaacttcacacgttggaggctcatcgttcctattccccccccccccccccccccccccccccccaggcagatgttatcgaggtccgacnnnnnnacacatcacaaaacaaaaa

SEQ ID NO: 1089 - DNA, 118 bp, Artificial Sequence
  Description of Artificial Sequence: Synthetic polynucleotide
  modified_base (89)..(94): a, c, t, g, unknown or other
acccctctcttcctctctaccctctatcaaaagttggaggctcatcgttcctattcccccccccaggcagatgttatcgaggtccgacnnnnnnttcccatttcacccttccactaat

SEQ ID NO: 1090 - DNA, 118 bp, Artificial Sequence
  Description of Artificial Sequence: Synthetic polynucleotide
  modified_base (89)..(94): a, c, t, g, unknown or other
ttactcacaacccaacaaacagttggaggctcatcgttcctattccccccccccccccccccccaggcagatgttatcgaggtccgacnnnnnnaaaaactatttaattcactaaact

SEQ ID NO: 1091 - DNA, 118 bp, Artificial Sequence
  Description of Artificial Sequence: Synthetic polynucleotide
  modified_base (91)..(96): a, c, t, g, unknown or other
ataataccaataaatcctactactattgttggaggctcatcgttcctattccccccccccccccccaggcagatgttatcgaggtccgacnnnnnnaaaaatctaaatcctacaaaaa

SEQ ID NO: 1092 - DNA, 118 bp, Artificial Sequence
  Description of Artificial Sequence: Synthetic polynucleotide
  modified_base (86)..(91): a, c, t, g, unknown or other
acacaactcaaaatcccgttggaggctcatcgttcctattcccccccccccccccccccccaggcagatgttatcgaggtccgacnnnnnnactctcctctttataaacaaccctaac

SEQ ID NO: 1093 - DNA, 118 bp, Artificial Sequence
  Description of Artificial Sequence: Synthetic polynucleotide
  modified_base (92)..(97): a, c, t, g, unknown or other
ccctattctaacaacaaacagttggaggctcatcgttcctattccccccccccccccccccccccccaggcagatgttatcgaggtccgacnnnnnnaaaataacacaatacctcact

SEQ ID NO: 1094 - DNA, 118 bp, Artificial Sequence
  Description of Artificial Sequence: Synthetic polynucleotide
  modified_base (89)..(94): a, c, t, g, unknown or other
ctaactctcccaacaaagttggaggctcatcgttcctattccccccccccccccccccccccccaggcagatgttatcgaggtccgacnnnnnntacaaatacaaatttaaccaaaaa

SEQ ID NO: 1095 - DNA, 118 bp, Artificial Sequence
  Description of Artificial Sequence: Synthetic polynucleotide
  modified_base (88)..(93): a, c, t, g, unknown or other
accctttacctaccaaccccaaccagttggaggctcatcgttcctattcccccccccccccccaggcagatgttatcgaggtccgacnnnnnnactataatacaaaaacctaattatt

SEQ ID NO: 1096 - DNA, 118 bp, Artificial Sequence
  Description of Artificial Sequence: Synthetic polynucleotide
  modified_base (92)..(97): a, c, t, g, unknown or other
ttaccaaatacctacatcaaaactgttggaggctcatcgttcctattccccccccccccccccccccaggcagatgttatcgaggtccgacnnnnnnaaaaactttaacataatcctc

SEQ ID NO: 1097 - DNA, 118 bp, Artificial Sequence
  Description of Artificial Sequence: Synthetic polynucleotide
  modified_base (89)..(94): a, c, t, g, unknown or other
cccaaaatacccattctccttatcccgttggaggctcatcgttcctattcccccccccccccccaggcagatgttatcgaggtccgacnnnnnnaaaataatattataactcaaacac

SEQ ID NO: 1098 - DNA, 118 bp, Artificial Sequence
  Description of Artificial Sequence: Synthetic polynucleotide
  modified_base (91)..(96): a, c, t, g, unknown or other
ccaaaaacccccaccataacgttggaggctcatcgttcctattcccccccccccccccccccccccaggcagatgttatcgaggtccgacnnnnnntaataaacaaaacccttaaaaa

SEQ ID NO: 1099 - DNA, 118 bp, Artificial Sequence
  Description of Artificial Sequence: Synthetic polynucleotide
  modified_base (88)..(93): a, c, t, g, unknown or other
attttcctattattatacttcaactttttgttggaggctcatcgttcctattcccccccccccaggcagatgttatcgaggtccgacnnnnnntccaataaactaaccaataacttat

SEQ ID NO: 1100 - DNA, 118 bp, Artificial Sequence
  Description of Artificial Sequence: Synthetic polynucleotide
  modified_base (89)..(94): a, c, t, g, unknown or other
ctcctactcttacttctaagttggaggctcatcgttcctattccccccccccccccccccccccaggcagatgttatcgaggtccgacnnnnnnactaaactactataatttcacttt

SEQ ID NO: 1101 - DNA, 118 bp, Artificial Sequence
  Description of Artificial Sequence: Synthetic polynucleotide
  modified_base (93)..(98): a, c, t, g, unknown or other
cacttccaaacactcaaactagttggaggctcatcgttcctattccccccccccccccccccccccccaggcagatgttatcgaggtccgacnnnnnnaactacactaccaaaataaa

SEQ ID NO: 1102 - DNA, 118 bp, Artificial Sequence
  Description of Artificial Sequence: Synthetic polynucleotide
  modified_base (91)..(96): a, c, t, g, unknown or other
attattcttttcactaaaaacctcattgttggaggctcatcgttcctattccccccccccccccccaggcagatgttatcgaggtccgacnnnnnntcttaccccataaaataataat

SEQ ID NO: 1103 - DNA, 118 bp, Artificial Sequence
  Description of Artificial Sequence: Synthetic polynucleotide
  modified_base (87)..(92): a, c, t, g, unknown or other
cctaactacctaccaccgttggaggctcatcgttcctattccccccccccccccccccccccaggcagatgttatcgaggtccgacnnnnnnacttcaattctaaaataaaaataaac

SEQ ID NO: 1104 - DNA, 118 bp, Artificial Sequence
  Description of Artificial Sequence: Synthetic polynucleotide
  modified_base (89)..(94): a, c, t, g, unknown or other
ctctacaaaccaacaacgttggaggctcatcgttcctattccccccccccccccccccccccccaggcagatgttatcgaggtccgacnnnnnnacaaacttaatatatctactacct

SEQ ID NO: 1105 - DNA, 118 bp, Artificial Sequence
  Description of Artificial Sequence: Synthetic polynucleotide
  modified_base (92)..(97): a, c, t, g, unknown or other
caccattaacacaataataaaaagttggaggctcatcgttcctattcccccccccccccccccccccaggcagatgttatcgaggtccgacnnnnnnaaaaactataccttctaaact

SEQ ID NO: 1106 - DNA, 118 bp, Artificial Sequence
  Description of Artificial Sequence: Synthetic polynucleotide
  modified_base (92)..(97): a, c, t, g, unknown or other
actcatacccactcactgttggaggctcatcgttcctattcccccccccccccccccccccccccccaggcagatgttatcgaggtccgacnnnnnntataacatcaaaacaaaatcc

SEQ ID NO: 1107 - DNA, 118 bp, Artificial Sequence
  Description of Artificial Sequence: Synthetic polynucleotide
  modified_base (87)..(92): a, c, t, g, unknown or other
atatatatattctatttactaaaatccaccgttggaggctcatcgttcctattcccccccccaggcagatgttatcgaggtccgacnnnnnnattaaactcatttttccatatcaatt

SEQ ID NO: 1108 - DNA, 118 bp, Artificial Sequence
  Description of Artificial Sequence: Synthetic polynucleotide
  modified_base (88)..(93): a, c, t, g, unknown or other
accccctaacccaacacttctaaaaacgttggaggctcatcgttcctattcccccccccccccaggcagatgttatcgaggtccgacnnnnnntaaaccccttctctaaaaccccaaa

SEQ ID NO: 1109 - DNA, 118 bp, Artificial Sequence
  Description of Artificial Sequence: Synthetic polynucleotide
  modified_base (92)..(97): a, c, t, g, unknown or other
actaaactcctcccccgttggaggctcatcgttcctattccccccccccccccccccccccccccccaggcagatgttatcgaggtccgacnnnnnnaacactctaactttaaaaact

SEQ ID NO: 1110 - DNA, 118 bp, Artificial Sequence
  Description of Artificial Sequence: Synthetic polynucleotide
  modified_base (89)..(94): a, c, t, g, unknown or other
ccctaactaaaccaaaccctagttggaggctcatcgttcctattccccccccccccccccccccaggcagatgttatcgaggtccgacnnnnnnaaaattacatttaacacttaaaaa

SEQ ID NO: 1111 - DNA, 118 bp, Artificial Sequence
  Description of Artificial Sequence: Synthetic polynucleotide
  modified_base (88)..(93): a, c, t, g, unknown or other
attcatccattccttcaacaaacatagttggaggctcatcgttcctattccccccccccccccaggcagatgttatcgaggtccgacnnnnnnattaacccaatcataattaaaccat

SEQ ID NO: 1112 - DNA, 118 bp, Artificial Sequence
  Description of Artificial Sequence: Synthetic polynucleotide
  modified_base (91)..(96): a, c, t, g, unknown or other
cacacacacacacacacgttggaggctcatcgttcctattccccccccccccccccccccccccccaggcagatgttatcgaggtccgacnnnnnncacatctaaaactatttacaat

SEQ ID NO: 1113 - DNA, 118 bp, Artificial Sequence
  Description of Artificial Sequence: Synthetic polynucleotide
  modified_base (84)..(89): a, c, t, g, unknown or other
acccccaacatttaaaaattaaataatcatcgttggaggctcatcgttcctattcccccaggcagatgttatcgaggtccgacnnnnnntacttaataactcccttattacaaacccc

SEQ ID NO: 1114 - DNA, 118 bp, Artificial Sequence
  Description of Artificial Sequence: Synthetic polynucleotide
  modified_base (94)..(99): a, c, t, g, unknown or other
acatacctaaaacccaacaacatccactcccgttggaggctcatcgttcctattcccccccccccccccaggcagatgttatcgaggtccgacnnnnnnacaatctctattccccaaa

SEQ ID NO: 1115 - DNA, 118 bp, Artificial Sequence; identical to SEQ ID NO: 532
  Description of Artificial Sequence: Synthetic polynucleotide
  modified_base (84)..(89): a, c, t, g, unknown or other

SEQ ID NO: 1116 - DNA, 118 bp, Artificial Sequence
  Description of Artificial Sequence: Synthetic polynucleotide
  modified_base (92)..(97): a, c, t, g, unknown or other
taacctaataaatacaacttcttaaagttggaggctcatcgttcctattccccccccccccccccccaggcagatgttatcgaggtccgacnnnnnnaaatcaaccacatataaatca

SEQ ID NO: 1117 - DNA, 118 bp, Artificial Sequence
  Description of Artificial Sequence: Synthetic polynucleotide
  modified_base (85)..(90): a, c, t, g, unknown or other
tttttcatctacccaaccctagttggaggctcatcgttcctattccccccccccccccccaggcagatgttatcgaggtccgacnnnnnnttccctctactcattcttccccaaaaac

SEQ ID NO: 1118 - DNA, 118 bp, Artificial Sequence
  Description of Artificial Sequence: Synthetic polynucleotide
  modified_base (90)..(95): a, c, t, g, unknown or other
tccttttcattctttcctccctctctgttggaggctcatcgttcctattccccccccccccccccaggcagatgttatcgaggtccgacnnnnnnaaaacaactttccttcaccttaa

SEQ ID NO: 1119 - DNA, 118 bp, Artificial Sequence
  Description of Artificial Sequence: Synthetic polynucleotide
  modified_base (83)..(88): a, c, t, g, unknown or other
aaatatataataatattaaacaaaccagttggaggctcatcgttcctattccccccccaggcagatgttatcgaggtccgacnnnnnnacaactttctcttcccaatccctaacctca

SEQ ID NO: 1120 - DNA, 118 bp, Artificial Sequence
  Description of Artificial Sequence: Synthetic polynucleotide
  modified_base (94)..(99): a, c, t, g, unknown or other
acttccctacaaccccgttggaggctcatcgttcctattccccccccccccccccccccccccccccccaggcagatgttatcgaggtccgacnnnnnntacaaaaacaaaccctaaa

SEQ ID NO: 1121 - DNA, 118 bp, Artificial Sequence
  Description of Artificial Sequence: Synthetic polynucleotide
  modified_base (87)..(92): a, c, t, g, unknown or other
ataaaattataaaatctctaatcctcctttgttggaggctcatcgttcctattcccccccccaggcagatgttatcgaggtccgacnnnnnnttaataataacttcccaaaatttata

SEQ ID NO: 1122 - DNA, 118 bp, Artificial Sequence
  Description of Artificial Sequence: Synthetic polynucleotide
  modified_base (92)..(97): a, c, t, g, unknown or other
acctccccctaccaacgttggaggctcatcgttcctattccccccccccccccccccccccccccccaggcagatgttatcgaggtccgacnnnnnnactctttatttttaccctttt

SEQ ID NO: 1123 - DNA, 118 bp, Artificial Sequence
  Description of Artificial Sequence: Synthetic polynucleotide
  modified_base (90)..(95): a, c, t, g, unknown or other
acactcaaaacaatacctaacacacagttggaggctcatcgttcctattccccccccccccccccaggcagatgttatcgaggtccgacnnnnnnatttatatatatatctacctccc

SEQ ID NO: 1124 - DNA, 118 bp, Artificial Sequence
  Description of Artificial Sequence: Synthetic polynucleotide
  modified_base (93)..(98): a, c, t, g, unknown or other
cactaactcatatctcataaacatgttggaggctcatcgttcctattcccccccccccccccccccccaggcagatgttatcgaggtccgacnnnnnnacaacatacttaactaaact

SEQ ID NO: 1125 - DNA, 118 bp, Artificial Sequence
  Description of Artificial Sequence: Synthetic polynucleotide
  modified_base (91)..(96): a, c, t, g, unknown or other
acttcctaccaccactccctctgttggaggctcatcgttcctattcccccccccccccccccccccaggcagatgttatcgaggtccgacnnnnnntttccctctaaatatcataata

SEQ ID NO: 1126 - DNA, 118 bp, Artificial Sequence
  Description of Artificial Sequence: Synthetic polynucleotide
  modified_base (87)..(92): a, c, t, g, unknown or other
acatttataatatttttctttaaacattagttggaggctcatcgttcctattccccccccccaggcagatgttatcgaggtccgacnnnnnnatttatcatacaaatataaataccct

SEQ ID NO: 1127 - DNA, 118 bp, Artificial Sequence
  Description of Artificial Sequence: Synthetic polynucleotide
  modified_base (85)..(90): a, c, t, g, unknown or other
atcccccaaccctcctaactactcaaatcgttggaggctcatcgttcctattccccccccaggcagatgttatcgaggtccgacnnnnnntccctactttctaactcaacctcctttt

SEQ ID NO: 1128 - DNA, 118 bp, Artificial Sequence
  Description of Artificial Sequence: Synthetic polynucleotide
  modified_base (87)..(92): a, c, t, g, unknown or other
ctaacccataaatccccgttggaggctcatcgttcctattccccccccccccccccccccccaggcagatgttatcgaggtccgacnnnnnntttttccaattttaaatataatttaa

SEQ ID NO: 1129 - DNA, 118 bp, Artificial Sequence
  Description of Artificial Sequence: Synthetic polynucleotide
  modified_base (92)..(97): a, c, t, g, unknown or other
ctaaacaaacctacaacctacgttggaggctcatcgttcctattcccccccccccccccccccccccaggcagatgttatcgaggtccgacnnnnnnaacaaacctctactaaaactt

SEQ ID NO: 1130 - DNA, 118 bp, Artificial Sequence
  Description of Artificial Sequence: Synthetic polynucleotide
  modified_base (91)..(96): a, c, t, g, unknown or other
tcaactaaataaaaccaaaaaccacgttggaggctcatcgttcctattccccccccccccccccccaggcagatgttatcgaggtccgacnnnnnntttcctaactaataaaacaaat

SEQ ID NO: 1131 - DNA, 118 bp, Artificial Sequence
  Description of Artificial Sequence: Synthetic polynucleotide
  modified_base (92)..(97): a, c, t, g, unknown or other
actccaacttaaaccaagttggaggctcatcgttcctattcccccccccccccccccccccccccccaggcagatgttatcgaggtccgacnnnnnntaaacaccacacacaaaactt

SEQ ID NO: 1132 - DNA, 118 bp, Artificial Sequence
  Description of Artificial Sequence: Synthetic polynucleotide
  modified_base (94)..(99): a, c, t, g, unknown or other
cttctaaaccctactaaataacgttggaggctcatcgttcctattccccccccccccccccccccccccaggcagatgttatcgaggtccgacnnnnnnacaaccttaataaccaact

SEQ ID NO: 1133 - DNA, 118 bp, Artificial Sequence
  Description of Artificial Sequence: Synthetic polynucleotide
  modified_base (91)..(96): a, c, t, g, unknown or other
atccctcatttcacaaataattaacaaaccacgttggaggctcatcgttcctattcccccccccccaggcagatgttatcgaggtccgacnnnnnnaaaacattcctcatcatccctt

SEQ ID NO: 1134 - DNA, 118 bp, Artificial Sequence
  Description of Artificial Sequence: Synthetic polynucleotide
  modified_base (93)..(98): a, c, t, g, unknown or other
caaaaaccaacttccctcaaaaagttggaggctcatcgttcctattccccccccccccccccccccccaggcagatgttatcgaggtccgacnnnnnntaaaacctttcacttcatac

SEQ ID NO: 1135 - DNA, 118 bp, Artificial Sequence
  Description of Artificial Sequence: Synthetic polynucleotide
  modified_base (95)..(100): a, c, t, g, unknown or other
ccaaacaatataacctccaccgttggaggctcatcgttcctattccccccccccccccccccccccccccaggcagatgttatcgaggtccgacnnnnnnttccaacctactctaaaa

SEQ ID NO: 1136 - DNA, 118 bp, Artificial Sequence
  Description of Artificial Sequence: Synthetic polynucleotide
  modified_base (97)..(102): a, c, t, g, unknown or other
accactctcttctaaaactagttggaggctcatcgttcctattcccccccccccccccccccccccccccccaggcagatgttatcgaggtccgacnnnnnncctcctacctcaccca

SEQ ID NO: 1137 - DNA, 118 bp, Artificial Sequence
  Description of Artificial Sequence: Synthetic polynucleotide
  modified_base (92)..(97): a, c, t, g, unknown or other
ccacaataattttcttcttcgttggaggctcatcgttcctattccccccccccccccccccccccccaggcagatgttatcgaggtccgacnnnnnntaaccaaactaaaaacaaaat

SEQ ID NO: 1138 - DNA, 118 bp, Artificial Sequence
  Description of Artificial Sequence: Synthetic polynucleotide
  modified_base (88)..(93): a, c, t, g, unknown or other
accttaaaaactacatctcccaaaatacactgttggaggctcatcgttcctattcccccccccaggcagatgttatcgaggtccgacnnnnnnaaataccctttcctaaatttaaaat

SEQ ID NO: 1139 - DNA, 118 bp, Artificial Sequence
  Description of Artificial Sequence: Synthetic polynucleotide
  modified_base (89)..(94): a, c, t, g, unknown or other
cctctaccaccattacccctaagttggaggctcatcgttcctattcccccccccccccccccccaggcagatgttatcgaggtccgacnnnnnnaaaactaaactaaactctacaaaa

SEQ ID NO: 1140 - DNA, 118 bp, Artificial Sequence
  Description of Artificial Sequence: Synthetic polynucleotide
  modified_base (91)..(96): a, c, t, g, unknown or other
ttttctaataaaattaaccaaacttgttggaggctcatcgttcctattccccccccccccccccccaggcagatgttatcgaggtccgacnnnnnntctaataaatcacaacataact

SEQ ID NO: 1141 - DNA, 118 bp, Artificial Sequence
  Description of Artificial Sequence: Synthetic polynucleotide
  modified_base (97)..(102): a, c, t, g, unknown or other
aaaaataactaaatcccccgttggaggctcatcgttcctattccccccccccccccccccccccccccccccaggcagatgttatcgaggtccgacnnnnnntcaccacaacttccta

SEQ ID NO: 1142 - DNA, 118 bp, Artificial Sequence
  Description of Artificial Sequence: Synthetic polynucleotide
  modified_base (93)..(98): a, c, t, g, unknown or other
cccaaaacaatctcatctaccacaacaaaagttggaggctcatcgttcctattcccccccccccccccaggcagatgttatcgaggtccgacnnnnnntttttcccacaattatacaa

SEQ ID NO: 1143 - DNA, 118 bp, Artificial Sequence
  Description of Artificial Sequence: Synthetic polynucleotide
  modified_base (93)..(98): a, c, t, g, unknown or other
acctcaccccaaacctgttggaggctcatcgttcctattcccccccccccccccccccccccccccccaggcagatgttatcgaggtccgacnnnnnntttccttcaactaacaaatt

SEQ ID NO: 1144 - DNA, 118 bp, Artificial Sequence
  Description of Artificial Sequence: Synthetic polynucleotide
  modified_base (90)..(95): a, c, t, g, unknown or other
ccactacattacaccaaccctaagttggaggctcatcgttcctattcccccccccccccccccccaggcagatgttatcgaggtccgacnnnnnntttacaccaaaaactcccactta

SEQ ID NO: 1145 - DNA, 118 bp, Artificial Sequence
  Description of Artificial Sequence: Synthetic polynucleotide
  modified_base (93)..(98): a, c, t, g, unknown or other
actctactaattaaacaaatttctcaactactgttggaggctcatcgttcctattcccccccccccccaggcagatgttatcgaggtccgacnnnnnnaatcaatcaacctatttcat

SEQ ID NO: 1146 - DNA, 118 bp, Artificial Sequence
  Description of Artificial Sequence: Synthetic polynucleotide
  modified_base (89)..(94): a, c, t, g, unknown or other
ccaaaacctccctaaaccgttggaggctcatcgttcctattcccccccccccccccccccccccaggcagatgttatcgaggtccgacnnnnnntataacctcccaacactcataaac

SEQ ID NO: 1147 - DNA, 118 bp, Artificial Sequence
  Description of Artificial Sequence: Synthetic polynucleotide
  modified_base (96)..(101): a, c, t, g, unknown or other
accaaacccacccaaccgttggaggctcatcgttcctattcccccccccccccccccccccccccccccccaggcagatgttatcgaggtccgacnnnnnntatccaatcttccccca

SEQ ID NO: 1148 - DNA, 118 bp, Artificial Sequence
  Description of Artificial Sequence: Synthetic polynucleotide
  modified_base (91)..(96): a, c, t, g, unknown or other
accccaccctctacccacatcctcgttggaggctcatcgttcctattcccccccccccccccccccaggcagatgttatcgaggtccgacnnnnnnactttctaaatacaattacaac

SEQ ID NO: 1149 - DNA, 118 bp, Artificial Sequence
  Description of Artificial Sequence: Synthetic polynucleotide
  modified_base (91)..(96): a, c, t, g, unknown or other
atttataaaatcaacaaaaacttgttggaggctcatcgttcctattccccccccccccccccccccaggcagatgttatcgaggtccgacnnnnnntaccaacatctctttatttatt

SEQ ID NO: 1150 - DNA, 118 bp, Artificial Sequence
  Description of Artificial Sequence: Synthetic polynucleotide
  modified_base (93)..(98): a, c, t, g, unknown or other
atctttccacaaacccgttggaggctcatcgttcctattcccccccccccccccccccccccccccccaggcagatgttatcgaggtccgacnnnnnntctaaccaaaaacaaaaact

SEQ ID NO: 1151 - DNA, 118 bp, Artificial Sequence
  Description of Artificial Sequence: Synthetic polynucleotide
  modified_base (92)..(97): a, c, t, g, unknown or other
ttacaacaatcacttccaaacactcagttggaggctcatcgttcctattccccccccccccccccccaggcagatgttatcgaggtccgacnnnnnnaaaaattcccacaactacact

SEQ ID NO: 1152 - DNA, 118 bp, Artificial Sequence
  Description of Artificial Sequence: Synthetic polynucleotide
  modified_base (88)..(93): a, c, t, g, unknown or other
acctcctactacaaacactcgttggaggctcatcgttcctattccccccccccccccccccccaggcagatgttatcgaggtccgacnnnnnntatattcttcaattttcaaaaatat

SEQ ID NO: 1153 - DNA, 118 bp, Artificial Sequence
  Description of Artificial Sequence: Synthetic polynucleotide
  modified_base (93)..(98): a, c, t, g, unknown or other
cctcatctcacaactcattaaccgttggaggctcatcgttcctattccccccccccccccccccccccaggcagatgttatcgaggtccgacnnnnnncaaaacctaaataaacacat

SEQ ID NO: 1154 - DNA, 118 bp, Artificial Sequence
  Description of Artificial Sequence: Synthetic polynucleotide
  modified_base (88)..(93): a, c, t, g, unknown or other
ctcttaaaaaccaaacccgttggaggctcatcgttcctattccccccccccccccccccccccaggcagatgttatcgaggtccgacnnnnnnacaaaacttaactccatctcaaaaa

SEQ ID NO: 1155 - DNA, 118 bp, Artificial Sequence
  Description of Artificial Sequence: Synthetic polynucleotide
  modified_base (94)..(99): a, c, t, g, unknown or other
tctaaatatactctaaacaaacttccccgttggaggctcatcgttcctattccccccccccccccccccaggcagatgttatcgaggtccgacnnnnnnacctaaacactaaacatct

SEQ ID NO: 1156 - DNA, 118 bp, Artificial Sequence
  Description of Artificial Sequence: Synthetic polynucleotide
  modified_base (95)..(100): a, c, t, g, unknown or other
tcaccaacaaacccaacaattctcccgttggaggctcatcgttcctattcccccccccccccccccccccaggcagatgttatcgaggtccgacnnnnnnaaacccacatctataact

SEQ ID NO: 1157 - DNA, 118 bp, Artificial Sequence
  Description of Artificial Sequence: Synthetic polynucleotide
  modified_base (94)..(99): a, c, t, g, unknown or other
aattacaattacaaactacaaagttggaggctcatcgttcctattccccccccccccccccccccccccaggcagatgttatcgaggtccgacnnnnnnacaattaaaacaaacacct

SEQ ID NO: 1158 - DNA, 118 bp, Artificial Sequence
  Description of Artificial Sequence: Synthetic polynucleotide
  modified_base (88)..(93): a, c, t, g, unknown or other
ataaaacctcacaaccccctaaagttggaggctcatcgttcctattcccccccccccccccccaggcagatgttatcgaggtccgacnnnnnnaaacacaaccacaaacacataaaat

SEQ ID NO: 1159 - DNA, 118 bp, Artificial Sequence
  Description of Artificial Sequence: Synthetic polynucleotide
  modified_base (93)..(98): a, c, t, g, unknown or other
actcattttctctttactctctcaatccaaccgttggaggctcatcgttcctattcccccccccccccaggcagatgttatcgaggtccgacnnnnnnaaccaacaactcccaaattt

SEQ ID NO: 1160 - DNA, 118 bp, Artificial Sequence
  Description of Artificial Sequence: Synthetic polynucleotide
  modified_base (88)..(93): a, c, t, g, unknown or other
acataaattacttttataaataaaaacactgttggaggctcatcgttcctattccccccccccaggcagatgttatcgaggtccgacnnnnnntttctattaacacaatttaaaattt

SEQ ID NO: 1161 - DNA, 118 bp, Artificial Sequence
  Description of Artificial Sequence: Synthetic polynucleotide
  modified_base (87)..(92): a, c, t, g, unknown or other
actctataacccaacaaacccgttggaggctcatcgttcctattccccccccccccccccccaggcagatgttatcgaggtccgacnnnnnnaaaaccaatttaaaattattataaaa

SEQ ID NO: 1162 - DNA, 118 bp, Artificial Sequence
  Description of Artificial Sequence: Synthetic polynucleotide
  modified_base (97)..(102): a, c, t, g, unknown or other
aaatactcctctccccatcccacaaacgttggaggctcatcgttcctattccccccccccccccccccccccaggcagatgttatcgaggtccgacnnnnnntcctacaacaaccaac

SEQ ID NO: 1163 - DNA, 118 bp, Artificial Sequence
  Description of Artificial Sequence: Synthetic polynucleotide
  modified_base (90)..(95): a, c, t, g, unknown or other
tcccactacatctacataacaagttggaggctcatcgttcctattccccccccccccccccccccaggcagatgttatcgaggtccgacnnnnnnatcttttcaaacataattctttt

SEQ ID NO: 1164 - DNA, 118 bp, Artificial Sequence
  Description of Artificial Sequence: Synthetic polynucleotide
  modified_base (83)..(88): a, c, t, g, unknown or other
attccttccctctccctctcgttggaggctcatcgttcctattcccccccccccccccaggcagatgttatcgaggtccgacnnnnnntaaatactactaaatctatataaataaacc

SEQ ID NO: 1165 - DNA, 118 bp, Artificial Sequence
  Description of Artificial Sequence: Synthetic polynucleotide
  modified_base (95)..(100): a, c, t, g, unknown or other
acctactctctaaccaccgttggaggctcatcgttcctattcccccccccccccccccccccccccccccaggcagatgttatcgaggtccgacnnnnnnaaaatcaaccaacttcct

SEQ ID NO: 1166 - DNA, 118 bp, Artificial Sequence
  Description of Artificial Sequence: Synthetic polynucleotide
  modified_base (91)..(96): a, c, t, g, unknown or other
actcctctctttatttcctaactagttggaggctcatcgttcctattcccccccccccccccccccaggcagatgttatcgaggtccgacnnnnnnaaacaaataaacaacatatcat

SEQ ID NO: 1167 - DNA, 118 bp, Artificial Sequence
  Description of Artificial Sequence: Synthetic polynucleotide
  modified_base (94)..(99): a, c, t, g, unknown or other
attttatcttctttcccccgttggaggctcatcgttcctattcccccccccccccccccccccccccccaggcagatgttatcgaggtccgacnnnnnnaaccaaccttacaaattaa

SEQ ID NO: 1168 - DNA, 118 bp, Artificial Sequence
  Description of Artificial Sequence: Synthetic polynucleotide
  modified_base (93)..(98): a, c, t, g, unknown or other
aaccataaacctaaaaccacgttggaggctcatcgttcctattcccccccccccccccccccccccccaggcagatgttatcgaggtccgacnnnnnnttaaacctaaactttaccca

SEQ ID NO: 1169 - DNA, 118 bp, Artificial Sequence
  Description of Artificial Sequence: Synthetic polynucleotide
  modified_base (91)..(96): a, c, t, g, unknown or other
acactaactctatattttattaacaacacctgttggaggctcatcgttcctattccccccccccccaggcagatgttatcgaggtccgacnnnnnnacatattctaataatttcccaa

SEQ ID NO: 1170 - DNA, 118 bp, Artificial Sequence
  Description of Artificial Sequence: Synthetic polynucleotide
  modified_base (86)..(91): a, c, t, g, unknown or other
ctcattcacacttaactaagttggaggctcatcgttcctattcccccccccccccccccccaggcagatgttatcgaggtccgacnnnnnnttataaaatattcaacctatataaaat

SEQ ID NO: 1171 - DNA, 118 bp, Artificial Sequence
  Description of Artificial Sequence: Synthetic polynucleotide
  modified_base (92)..(97): a, c, t, g, unknown or other
cttcttcccaaaatcaaagttggaggctcatcgttcctattccccccccccccccccccccccccccaggcagatgttatcgaggtccgacnnnnnnaaaaatctctaaaaatacacc

SEQ ID NO: 1172 - DNA, 118 bp, Artificial Sequence
  Description of Artificial Sequence: Synthetic polynucleotide
  modified_base (91)..(96): a, c, t, g, unknown or other
acaaccaaacttaacccgttggaggctcatcgttcctattccccccccccccccccccccccccccaggcagatgttatcgaggtccgacnnnnnntacaaaattcctccaatataaa

SEQ ID NO: 1173 - DNA, 118 bp, Artificial Sequence
  Description of Artificial Sequence: Synthetic polynucleotide
  modified_base (93)..(98): a, c, t, g, unknown or other
ataaccccttccaaacgttggaggctcatcgttcctattcccccccccccccccccccccccccccccaggcagatgttatcgaggtccgacnnnnnnactccctaataactaacttt

SEQ ID NO: 1174 - DNA, 118 bp, Artificial Sequence
  Description of Artificial Sequence: Synthetic polynucleotide
  modified_base (90)..(95): a, c, t, g, unknown or other
acctaaaaatcctcctaaaaaccaaacccgttggaggctcatcgttcctattcccccccccccccaggcagatgttatcgaggtccgacnnnnnntccctcatctcaaacatacctac

SEQ ID NO: 1175 - DNA, 118 bp, Artificial Sequence
  Description of Artificial Sequence: Synthetic polynucleotide
  modified_base (89)..(94): a, c, t, g, unknown or other
taacaactctatattaactaatacagttggaggctcatcgttcctattccccccccccccccccaggcagatgttatcgaggtccgacnnnnnnaaaactaaaacaatcttctaatca

SEQ ID NO: 1176 - DNA, 118 bp, Artificial Sequence
  Description of Artificial Sequence: Synthetic polynucleotide
  modified_base (90)..(95): a, c, t, g, unknown or other
aaacatttcaacaccacgttggaggctcatcgttcctattcccccccccccccccccccccccccaggcagatgttatcgaggtccgacnnnnnnactaatatacaaattcctaaaaa

SEQ ID NO: 1177 - DNA, 118 bp, Artificial Sequence
  Description of Artificial Sequence: Synthetic polynucleotide
  modified_base (93)..(98): a, c, t, g, unknown or other
cccttaatctttaaccaaaccgttggaggctcatcgttcctattccccccccccccccccccccccccaggcagatgttatcgaggtccgacnnnnnnaaactccctaacacctcttt

SEQ ID NO: 1178 - DNA, 118 bp, Artificial Sequence
  Description of Artificial Sequence: Synthetic polynucleotide
  modified_base (84)..(89): a, c, t, g, unknown or other
acctttcacttactccacatatacttattaaagttggaggctcatcgttcctattccccaggcagatgttatcgaggtccgacnnnnnnaaattattttattattcctctcttccccc

SEQ ID NO: 1179 - DNA, 118 bp, Artificial Sequence
  Description of Artificial Sequence: Synthetic polynucleotide
  modified_base (93)..(98): a, c, t, g, unknown or other
accaaccttaacacccaagttggaggctcatcgttcctattcccccccccccccccccccccccccccaggcagatgttatcgaggtccgacnnnnnnactaaaacaacatacttcaa

SEQ ID NO: 1180 - DNA, 118 bp, Artificial Sequence
  Description of Artificial Sequence: Synthetic polynucleotide
  modified_base (90)..(95): a, c, t, g, unknown or other
tctctaaaaccccctcctaaagttggaggctcatcgttcctattcccccccccccccccccccccaggcagatgttatcgaggtccgacnnnnnnaatattcttctaataaacaaact

SEQ ID NO: 1181 - DNA, 118 bp, Artificial Sequence
  Description of Artificial Sequence: Synthetic polynucleotide
  modified_base (84)..(89): a, c, t, g, unknown or other
acataactaaaaacctactaaactgttggaggctcatcgttcctattccccccccccccaggcagatgttatcgaggtccgacnnnnnnttaaaattttcttcaaatatttaatactt

SEQ ID NO: 1182 - DNA, 118 bp, Artificial Sequence
  Description of Artificial Sequence: Synthetic polynucleotide
  modified_base (93)..(98): a, c, t, g, unknown or other
tacaaacaaatttaaatccaaaatccctgttggaggctcatcgttcctattcccccccccccccccccaggcagatgttatcgaggtccgacnnnnnntttacctttatacttcacac

SEQ ID NO: 1183 - DNA, 118 bp, Artificial Sequence
  Description of Artificial Sequence: Synthetic polynucleotide
  modified_base (94)..(99): a, c, t, g, unknown or other
ctctaactaatttatttatccacaagttggaggctcatcgttcctattcccccccccccccccccccccaggcagatgttatcgaggtccgacnnnnnnaaccaaacatttaacttca

SEQ ID NO: 1184 - DNA, 118 bp, Artificial Sequence
  Description of Artificial Sequence: Synthetic polynucleotide
  modified_base (89)..(94): a, c, t, g, unknown or other
aaaaactaacaaaccctaaatgttggaggctcatcgttcctattccccccccccccccccccccaggcagatgttatcgaggtccgacnnnnnntcaatttcctcctataaaataaaa

SEQ ID NO: 1185 - DNA, 118 bp, Artificial Sequence
  Description of Artificial Sequence: Synthetic polynucleotide
  modified_base (90)..(95): a, c, t, g, unknown or other
tcaatcctccccaaaaaccacctaaatgttggaggctcatcgttcctattcccccccccccccccaggcagatgttatcgaggtccgacnnnnnnaaaataatataaaactacctctc

SEQ ID NO: 1186 - DNA, 118 bp, Artificial Sequence
  Description of Artificial Sequence: Synthetic polynucleotide
  modified_base (87)..(92): a, c, t, g, unknown or other
atccctatctcaaaaacatccaaaacacgttggaggctcatcgttcctattcccccccccccaggcagatgttatcgaggtccgacnnnnnnaataaacacaatcataatattattat

SEQ ID NO: 1187 - DNA, 118 bp, Artificial Sequence
  Description of Artificial Sequence: Synthetic polynucleotide
  modified_base (94)..(99): a, c, t, g, unknown or other
aaacacaacctacaataaccgttggaggctcatcgttcctattccccccccccccccccccccccccccaggcagatgttatcgaggtccgacnnnnnnctacccacctaataaatca

SEQ ID NO: 1188 - DNA, 118 bp, Artificial Sequence
  Description of Artificial Sequence: Synthetic polynucleotide
  modified_base (89)..(94): a, c, t, g, unknown or other
acaaaattaactcttcttaaaacctaacttaagttggaggctcatcgttcctattcccccccccaggcagatgttatcgaggtccgacnnnnnnattaaaattattttccttaacaat

SEQ ID NO: 1189 - DNA, 118 bp, Artificial Sequence
  Description of Artificial Sequence: Synthetic polynucleotide
  modified_base (88)..(93): a, c, t, g, unknown or other
ccccctaacactaccacgttggaggctcatcgttcctattcccccccccccccccccccccccaggcagatgttatcgaggtccgacnnnnnnatttctacttcttatttttatttac

SEQ ID NO: 1190 - DNA, 118 bp, Artificial Sequence
  Description of Artificial Sequence: Synthetic polynucleotide
  modified_base (93)..(98): a, c, t, g, unknown or other
cttaattcctcttaactaatacagttggaggctcatcgttcctattccccccccccccccccccccccaggcagatgttatcgaggtccgacnnnnnntctaataactacaacaacaa

SEQ ID NO: 1191 - DNA, 118 bp, Artificial Sequence
  Description of Artificial Sequence: Synthetic polynucleotide
  modified_base (95)..(100): a, c, t, g, unknown or other
acccctacctttttccgttggaggctcatcgttcctattcccccccccccccccccccccccccccccccaggcagatgttatcgaggtccgacnnnnnnactctaaattctcaaccc

SEQ ID NO: 1192 - DNA, 118 bp, Artificial Sequence
  Description of Artificial Sequence: Synthetic polynucleotide
  modified_base (93)..(98): a, c, t, g, unknown or other
tcataataaaaatcccctacaccgttggaggctcatcgttcctattccccccccccccccccccccccaggcagatgttatcgaggtccgacnnnnnntacattccacctaaactata

SEQ ID NO: 1193 - DNA, 118 bp, Artificial Sequence
  Description of Artificial Sequence: Synthetic polynucleotide
  modified_base (89)..(94): a, c, t, g, unknown or other
aaaatccccaattctcccgttggaggctcatcgttcctattcccccccccccccccccccccccaggcagatgttatcgaggtccgacnnnnnntttaaactcctaaaatctcaacca

SEQ ID NO: 1194 - DNA, 118 bp, Artificial Sequence
  Description of Artificial Sequence: Synthetic polynucleotide
  modified_base (94)..(99): a, c, t, g, unknown or other
tcataaactaattcatctactccctgttggaggctcatcgttcctattcccccccccccccccccccccaggcagatgttatcgaggtccgacnnnnnnaaaaccaactacaaacttt

SEQ ID NO: 1195 - DNA, 118 bp, Artificial Sequence
  Description of Artificial Sequence: Synthetic polynucleotide
  modified_base (92)..(97): a, c, t, g, unknown or other
aaaaatacccctaaccctctgttggaggctcatcgttcctattccccccccccccccccccccccccaggcagatgttatcgaggtccgacnnnnnnaaaccctaccaaaaacaaaaa

SEQ ID NO: 1196 - DNA, 118 bp, Artificial Sequence
  Description of Artificial Sequence: Synthetic polynucleotide
  modified_base (89)..(94): a, c, t, g, unknown or other
atcaacataactaatactaccctaaaacacccgttggaggctcatcgttcctattcccccccccaggcagatgttatcgaggtccgacnnnnnnttattaaatttattctcatttcct

SEQ ID NO: 1197 - DNA, 118 bp, Artificial Sequence
  Description of Artificial Sequence: Synthetic polynucleotide
  modified_base (92)..(97): a, c, t, g, unknown or other
atttttactccctatacacaaaccaccgttggaggctcatcgttcctattcccccccccccccccccaggcagatgttatcgaggtccgacnnnnnnaaccaatttcctaactaatat

SEQ ID NO: 1198 - DNA, 118 bp, Artificial Sequence
  Description of Artificial Sequence: Synthetic polynucleotide
  modified_base (92)..(97): a, c, t, g, unknown or other
attcaccacctacttccgttggaggctcatcgttcctattcccccccccccccccccccccccccccaggcagatgttatcgaggtccgacnnnnnntttactaaccaaacaacacta

SEQ ID NO: 1199 - DNA, 118 bp, Artificial Sequence
  Description of Artificial Sequence: Synthetic polynucleotide
  modified_base (96)..(101): a, c, t, g, unknown or other
accactacaatactcacacgttggaggctcatcgttcctattcccccccccccccccccccccccccccccaggcagatgttatcgaggtccgacnnnnnnactaaacccccaaaaca

SEQ ID NO: 1200 - DNA, 118 bp, Artificial Sequence
  Description of Artificial Sequence: Synthetic polynucleotide
  modified_base (93)..(98): a, c, t, g, unknown or other
acaaaaactcaacaaactctgttggaggctcatcgttcctattcccccccccccccccccccccccccaggcagatgttatcgaggtccgacnnnnnnatcacatcaaatcaacaaat

SEQ ID NO: 1201 - DNA, 118 bp, Artificial Sequence
  Description of Artificial Sequence: Synthetic polynucleotide
  modified_base (95)..(100): a, c, t, g, unknown or other
atttccctaaaaccttctccgttggaggctcatcgttcctattcccccccccccccccccccccccccccaggcagatgttatcgaggtccgacnnnnnnaccaactactttccttct

SEQ ID NO: 1202 - DNA, 118 bp, Artificial Sequence
  Description of Artificial Sequence: Synthetic polynucleotide
  modified_base (88)..(93): a, c, t, g, unknown or other
tcctacatcaataccatctctatcccgttggaggctcatcgttcctattccccccccccccccaggcagatgttatcgaggtccgacnnnnnntctaacacctcttccttccactccc

SEQ ID NO: 1203 - DNA, 118 bp, Artificial Sequence
  Description of Artificial Sequence: Synthetic polynucleotide
  modified_base (90)..(95): a, c, t, g, unknown or other
acaacccacactccccacactaccgttggaggctcatcgttcctattccccccccccccccccccaggcagatgttatcgaggtccgacnnnnnnatcaattatccacttatccataa

SEQ ID NO: 1204 - DNA, 118 bp, Artificial Sequence
  Description of Artificial Sequence: Synthetic polynucleotide
  modified_base (96)..(101): a, c, t, g, unknown or other
ccataattaaacccaccaaaacgttggaggctcatcgttcctattccccccccccccccccccccccccccaggcagatgttatcgaggtccgacnnnnnnacaaacctcaacttacc

SEQ ID NO: 1205 - DNA, 118 bp, Artificial Sequence
  Description of Artificial Sequence: Synthetic polynucleotide
  modified_base (86)..(91): a, c, t, g, unknown or other
tttaacaactactctaaaaccgttggaggctcatcgttcctattcccccccccccccccccaggcagatgttatcgaggtccgacnnnnnnaaataatttcccttcctacccacccac

SEQ ID NO: 1206 - DNA, 118 bp, Artificial Sequence
  Description of Artificial Sequence: Synthetic polynucleotide
  modified_base (94)..(99): a, c, t, g, unknown or other
ccaaactaataaccaaacctagttggaggctcatcgttcctattcccccccccccccccccccccccccaggcagatgttatcgaggtccgacnnnnnntttaaatcctaccttccaa

SEQ ID NO: 1207 - DNA, 118 bp, Artificial Sequence
  Description of Artificial Sequence: Synthetic polynucleotide
  modified_base (95)..(100): a, c, t, g, unknown or other
ccatcaaaccactcaaccatgttggaggctcatcgttcctattcccccccccccccccccccccccccccaggcagatgttatcgaggtccgacnnnnnnaaactaacatctccctct

SEQ ID NO: 1208 - DNA, 118 bp, Artificial Sequence
  Description of Artificial Sequence: Synthetic polynucleotide
  modified_base (89)..(94): a, c, t, g, unknown or other
accctaaaaactaattaaactgttggaggctcatcgttcctattccccccccccccccccccccaggcagatgttatcgaggtccgacnnnnnntaatcctacaattctttataaacc

SEQ ID NO: 1209 - DNA, 118 bp, Artificial Sequence
  Description of Artificial Sequence: Synthetic polynucleotide
  modified_base (94)..(99): a, c, t, g, unknown or other
accaaatactacttatcccgttggaggctcatcgttcctattcccccccccccccccccccccccccccaggcagatgttatcgaggtccgacnnnnnnaaaaactacctcctacaaa

SEQ ID NO: 1210 - DNA, 118 bp, Artificial Sequence
  Description of Artificial Sequence: Synthetic polynucleotide
  modified_base (91)..(96): a, c, t, g, unknown or other
actaaaaacatctaataacccgttggaggctcatcgttcctattccccccccccccccccccccccaggcagatgttatcgaggtccgacnnnnnntaaatcactaaacaaaacaaat

SEQ ID NO: 1211 - DNA, 118 bp, Artificial Sequence
  Description of Artificial Sequence: Synthetic polynucleotide
  modified_base (94)..(99): a, c, t, g, unknown or other
caacttttcaaacctcaccgttggaggctcatcgttcctattcccccccccccccccccccccccccccaggcagatgttatcgaggtccgacnnnnnnaaaccctaaaaactcaaaa

SEQ ID NO: 1212 - DNA, 118 bp, Artificial Sequence
  Description of Artificial Sequence: Synthetic polynucleotide
  modified_base (93)..(98): a, c, t, g, unknown or other
cctaataaaacaaactaaccagttggaggctcatcgttcctattccccccccccccccccccccccccaggcagatgttatcgaggtccgacnnnnnntttcctcaaataaaacaact

SEQ ID NO: 1213 - DNA, 118 bp, Artificial Sequence
  Description of Artificial Sequence: Synthetic polynucleotide
  modified_base (84)..(89): a, c, t, g, unknown or other
atttccttcccacatcctcacctcctgttggaggctcatcgttcctattccccccccccaggcagatgttatcgaggtccgacnnnnnnttctttttacctccctttataaaacaaaa

SEQ ID NO: 1214 - DNA, 118 bp, Artificial Sequence
  Description of Artificial Sequence: Synthetic polynucleotide
  modified_base (85)..(90): a, c, t, g, unknown or other
acacccttttcctaaacaaacacagttggaggctcatcgttcctattcccccccccccccaggcagatgttatcgaggtccgacnnnnnnttattcttttccctaatctctaccaaat

SEQ ID NO: 1215 - DNA, 118 bp, Artificial Sequence
  Description of Artificial Sequence: Synthetic polynucleotide
  modified_base (91)..(96): a, c, t, g, unknown or other
acctcttccttccctctacaaaaacacccgttggaggctcatcgttcctattccccccccccccccaggcagatgttatcgaggtccgacnnnnnnaattataaccaacaaccaaatt

SEQ ID NO: 1216 - DNA, 118 bp, Artificial Sequence
  Description of Artificial Sequence: Synthetic polynucleotide
  modified_base (92)..(97): a, c, t, g, unknown or other
actccttccataacccgttggaggctcatcgttcctattccccccccccccccccccccccccccccaggcagatgttatcgaggtccgacnnnnnntttaaccacttcctttttcac

SEQ ID NO: 1217 - DNA, 118 bp, Artificial Sequence
  Description of Artificial Sequence: Synthetic polynucleotide
  modified_base (84)..(89): a, c, t, g, unknown or other
attcctatctatacacctcctcctatcttcagttggaggctcatcgttcctattcccccaggcagatgttatcgaggtccgacnnnnnntttaatactaaaacccaccctaatacccc

SEQ ID NO: 1218 - DNA, 118 bp, Artificial Sequence
  Description of Artificial Sequence: Synthetic polynucleotide
  modified_base (93)..(98): a, c, t, g, unknown or other
ccttctaatccaatatcccgttggaggctcatcgttcctattccccccccccccccccccccccccccaggcagatgttatcgaggtccgacnnnnnnaaaaacaaaacaacaaaaac

SEQ ID NO: 1219 - DNA, 118 bp, Artificial Sequence
  Description of Artificial Sequence: Synthetic polynucleotide
  modified_base (85)..(90): a, c, t, g, unknown or other
ccccacaacctacactcctcccagttggaggctcatcgttcctattccccccccccccccaggcagatgttatcgaggtccgacnnnnnnattaatacactaaaatcaccttaaacca

SEQ ID NO: 1220 - DNA, 118 bp, Artificial Sequence
  Description of Artificial Sequence: Synthetic polynucleotide
  modified_base (92)..(97): a, c, t, g, unknown or other
ccctaaactaaacaccaaagttggaggctcatcgttcctattcccccccccccccccccccccccccaggcagatgttatcgaggtccgacnnnnnntctctatcctcttctttatta

SEQ ID NO: 1221 - DNA, 118 bp, Artificial Sequence
  Description of Artificial Sequence: Synthetic polynucleotide
  modified_base (88)..(93): a, c, t, g, unknown or other
acctcttaattactttcccttcaaacctcgttggaggctcatcgttcctattcccccccccccaggcagatgttatcgaggtccgacnnnnnnaacccaacaacctcatcaccttcct

SEQ ID NO: 1222 - DNA, 118 bp, Artificial Sequence
  Description of Artificial Sequence: Synthetic polynucleotide
  modified_base (89)..(94): a, c, t, g, unknown or other
accccactctcccatctaaaccccatcgttggaggctcatcgttcctattccccccccccccccaggcagatgttatcgaggtccgacnnnnnnaaaacaaccatcaactatcaaaaa

SEQ ID NO: 1223 - DNA, 118 bp, Artificial Sequence
  Description of Artificial Sequence: Synthetic polynucleotide
  modified_base (93)..(98): a, c, t, g, unknown or other
aaacctcacataccccgttggaggctcatcgttcctattcccccccccccccccccccccccccccccaggcagatgttatcgaggtccgacnnnnnnaaacttactttttccctcaa

SEQ ID NO: 1224 - DNA, 118 bp, Artificial Sequence
  Description of Artificial Sequence: Synthetic polynucleotide
  modified_base (91)..(96): a, c, t, g, unknown or other
acaaaacccctctcctatctctcctctcgttggaggctcatcgttcctattcccccccccccccccaggcagatgttatcgaggtccgacnnnnnnaaaccctttaccaaacccacaa

SEQ ID NO: 1225 - DNA, 118 bp, Artificial Sequence
  Description of Artificial Sequence: Synthetic polynucleotide
  modified_base (94)..(99): a, c, t, g, unknown or other
aaacacattaaaataccatcgttggaggctcatcgttcctattccccccccccccccccccccccccccaggcagatgttatcgaggtccgacnnnnnnaaccaaaatactcaaactt

SEQ ID NO: 1226 - DNA, 118 bp, Artificial Sequence
  Description of Artificial Sequence: Synthetic polynucleotide
  modified_base (91)..(96): a, c, t, g, unknown or other
cctcaaaccttccctcctccccaaactagttggaggctcatcgttcctattcccccccccccccccaggcagatgttatcgaggtccgacnnnnnnaaaaaccacaacccaattccca

SEQ ID NO: 1227 - DNA, 118 bp, Artificial Sequence
  Description of Artificial Sequence: Synthetic polynucleotide
  modified_base (91)..(96): a, c, t, g, unknown or other
caaaactacataactaaaccgttggaggctcatcgttcctattcccccccccccccccccccccccaggcagatgttatcgaggtccgacnnnnnntcccataaacaatatacttttt

SEQ ID NO: 1228 - DNA, 118 bp, Artificial Sequence
  Description of Artificial Sequence: Synthetic polynucleotide
  modified_base (89)..(94): a, c, t, g, unknown or other
cctacctccaaccactgttggaggctcatcgttcctattcccccccccccccccccccccccccaggcagatgttatcgaggtccgacnnnnnnaactctataacttaaatctaaaaa

SEQ ID NO: 1229 - DNA, 118 bp, Artificial Sequence
  Description of Artificial Sequence: Synthetic polynucleotide
  modified_base (85)..(90): a, c, t, g, unknown or other
attccaacaacttaaataaaaagttggaggctcatcgttcctattcccccccccccccccaggcagatgttatcgaggtccgacnnnnnnattatatttttcccctaactttccatat

SEQ ID NO: 1230 - DNA, 118 bp, Artificial Sequence
  Description of Artificial Sequence: Synthetic polynucleotide
  modified_base (88)..(93): a, c, t, g, unknown or other
accctcacccaaaaatataacttatcacaagttggaggctcatcgttcctattccccccccccaggcagatgttatcgaggtccgacnnnnnntcctctaaaaccctattctttaccc

SEQ ID NO: 1231 - DNA, 118 bp, Artificial Sequence
  Description of Artificial Sequence: Synthetic polynucleotide
  modified_base (90)..(95): a, c, t, g, unknown or other
cttccctccaactctaagttggaggctcatcgttcctattcccccccccccccccccccccccccaggcagatgttatcgaggtccgacnnnnnnactaaatctatcctaaatctttt

SEQ ID NO: 1232 - DNA, 118 bp, Artificial Sequence
  Description of Artificial Sequence: Synthetic polynucleotide
  modified_base (93)..(98): a, c, t, g, unknown or other
tcctacaacctctctaatatctcatatgttggaggctcatcgttcctattccccccccccccccccccaggcagatgttatcgaggtccgacnnnnnntcactcctaatttctaaaca

SEQ ID NO: 1233 - DNA, 118 bp, Artificial Sequence
  Description of Artificial Sequence: Synthetic polynucleotide
  modified_base (88)..(93): a, c, t, g, unknown or other
ttccacttttactttctctgttggaggctcatcgttcctattcccccccccccccccccccccaggcagatgttatcgaggtccgacnnnnnnacctttaattaaaatcataacttta

SEQ ID NO: 1234 - DNA, 118 bp, Artificial Sequence
  Description of Artificial Sequence: Synthetic polynucleotide
  modified_base (91)..(96): a, c, t, g, unknown or other
taaataatctacaccaaactagttggaggctcatcgttcctattccccccccccccccccccccccaggcagatgttatcgaggtccgacnnnnnnattcataataccccctataaaa

SEQ ID NO: 1235 - DNA, 118 bp, Artificial Sequence
  Description of Artificial Sequence: Synthetic polynucleotide
  modified_base (95)..(100): a, c, t, g, unknown or other
ctaaaacaaaaataaaatcccattccaacgttggaggctcatcgttcctattccccccccccccccccccaggcagatgttatcgaggtccgacnnnnnnacacacacacacacacac

SEQ ID NO: 1236 - DNA, 118 bp, Artificial Sequence
  Description of Artificial Sequence: Synthetic polynucleotide
  modified_base (88)..(93): a, c, t, g, unknown or other
acccaaccaaaaccaccctacaaaataacaaagttggaggctcatcgttcctattccccccccaggcagatgttatcgaggtccgacnnnnnnaaaaatttcctaaacatcttttcta

SEQ ID NO: 1237 - DNA, 118 bp, Artificial Sequence
  Description of Artificial Sequence: Synthetic polynucleotide
  modified_base (83)..(88): a, c, t, g, unknown or other
atttccctaaacaaaatacccttgttggaggctcatcgttcctattccccccccccccaggcagatgttatcgaggtccgacnnnnnntaaatttccattaacaacactaaaacctcc

SEQ ID NO: 1238 - DNA, 118 bp, Artificial Sequence
  Description of Artificial Sequence: Synthetic polynucleotide
  modified_base (92)..(97): a, c, t, g, unknown or other
caaaaattacatctccctaaacgttggaggctcatcgttcctattccccccccccccccccccccccaggcagatgttatcgaggtccgacnnnnnnaaatctcacaccctccaaaaa

SEQ ID NO: 1239 - DNA, 118 bp, Artificial Sequence
  Description of Artificial Sequence: Synthetic polynucleotide
  modified_base (83)..(88): a, c, t, g, unknown or other
accccaacattctccctaaaaccctccgttggaggctcatcgttcctattccccccccaggcagatgttatcgaggtccgacnnnnnnataaaaataatttctatttccaataaaaat

SEQ ID NO: 1240 - DNA, 118 bp, Artificial Sequence
  Description of Artificial Sequence: Synthetic polynucleotide
  modified_base (88)..(93): a, c, t, g, unknown or other
cctacctttcctttcccgttggaggctcatcgttcctattcccccccccccccccccccccccaggcagatgttatcgaggtccgacnnnnnnccattaaaaataaaaatattctacc

SEQ ID NO: 1241 - DNA, 118 bp, Artificial Sequence
  Description of Artificial Sequence: Synthetic polynucleotide
  modified_base (86)..(91): a, c, t, g, unknown or other
caactactccaatccctaaagttggaggctcatcgttcctattccccccccccccccccccaggcagatgttatcgaggtccgacnnnnnnctctctctctcatacacacacacacac

SEQ ID NO: 1242 - DNA, 118 bp, Artificial Sequence
  Description of Artificial Sequence: Synthetic polynucleotide
  modified_base (90)..(95): a, c, t, g, unknown or other
ttaatttcctatatcctcctcgttggaggctcatcgttcctattcccccccccccccccccccccaggcagatgttatcgaggtccgacnnnnnnactactattcaatttactaatct

SEQ ID NO: 1243 - DNA, 118 bp, Artificial Sequence
  Description of Artificial Sequence: Synthetic polynucleotide
  modified_base (88)..(93): a, c, t, g, unknown or other
atcaaaatcccaaatacacaagttggaggctcatcgttcctattcccccccccccccccccccaggcagatgttatcgaggtccgacnnnnnntttcacttccacatctaccaaataa

SEQ ID NO: 1244 - DNA, 118 bp, Artificial Sequence
  Description of Artificial Sequence: Synthetic polynucleotide
  modified_base (90)..(95): a, c, t, g, unknown or other
atttcattttctttccatataactgttggaggctcatcgttcctattccccccccccccccccccaggcagatgttatcgaggtccgacnnnnnnactaatttaatacacacataaat

SEQ ID NO: 1245 - DNA, 118 bp, Artificial Sequence
  Description of Artificial Sequence: Synthetic polynucleotide
  modified_base (85)..(90): a, c, t, g, unknown or other
ccacaaaacatcaaacttgttggaggctcatcgttcctattcccccccccccccccccccaggcagatgttatcgaggtccgacnnnnnnaattttatataatatatcccttcttttt

SEQ ID NO: 1246 - DNA, 118 bp, Artificial Sequence
  Description of Artificial Sequence: Synthetic polynucleotide
  modified_base (87)..(92): a, c, t, g, unknown or other
aaaaatcaaattacctaaaatatcgttggaggctcatcgttcctattcccccccccccccccaggcagatgttatcgaggtccgacnnnnnntaattttctaaacaaaatatacattt

SEQ ID NO: 1247 - DNA, 118 bp, Artificial Sequence
  Description of Artificial Sequence: Synthetic polynucleotide
  modified_base (95)..(100): a, c, t, g, unknown or other
ccacaaccctaaataaccaagttggaggctcatcgttcctattcccccccccccccccccccccccccccaggcagatgttatcgaggtccgacnnnnnnttaccctcaatcctacaa

SEQ ID NO: 1248 - DNA, 118 bp, Artificial Sequence
  Description of Artificial Sequence: Synthetic polynucleotide
  modified_base (93)..(98): a, c, t, g, unknown or other
caaaaacaatcttaaactcccctgttggaggctcatcgttcctattccccccccccccccccccccccaggcagatgttatcgaggtccgacnnnnnntctacttatccacacactta

SEQ ID NO: 1249 - DNA, 118 bp, Artificial Sequence
  Description of Artificial Sequence: Synthetic polynucleotide
  modified_base (92)..(97): a, c, t, g, unknown or other
tcaacaacacctcctaaaacaaatgttggaggctcatcgttcctattccccccccccccccccccccaggcagatgttatcgaggtccgacnnnnnntttactacaaaccttacaaaa

SEQ ID NO: 1250 - DNA, 118 bp, Artificial Sequence
  Description of Artificial Sequence: Synthetic polynucleotide
  modified_base (92)..(97): a, c, t, g, unknown or other
acaaacacactcccaacaaccacacgttggaggctcatcgttcctattcccccccccccccccccccaggcagatgttatcgaggtccgacnnnnnnatccctaatctaataaacaaa

SEQ ID NO: 1251 - DNA, 118 bp, Artificial Sequence
  Description of Artificial Sequence: Synthetic polynucleotide
  modified_base (89)..(94): a, c, t, g, unknown or other
ttttcctcccaacaactaaaacgttggaggctcatcgttcctattcccccccccccccccccccaggcagatgttatcgaggtccgacnnnnnntaatcttttaccttaaacctactt

SEQ ID NO: 1252 - DNA, 118 bp, Artificial Sequence
  Description of Artificial Sequence: Synthetic polynucleotide
  modified_base (87)..(92): a, c, t, g, unknown or other
ccccacccccaataccaccctgttggaggctcatcgttcctattccccccccccccccccccaggcagatgttatcgaggtccgacnnnnnnacatatatccttactacatatattat

SEQ ID NO: 1253 - DNA, 118 bp, Artificial Sequence
  Description of Artificial Sequence: Synthetic polynucleotide
  modified_base (92)..(97): a, c, t, g, unknown or other
actttcaaattcacaaccacaaacctcagttggaggctcatcgttcctattccccccccccccccccaggcagatgttatcgaggtccgacnnnnnnaccctaataataattccaatt

SEQ ID NO: 1254 - DNA, 118 bp, Artificial Sequence
  Description of Artificial Sequence: Synthetic polynucleotide
  modified_base (94)..(99): a, c, t, g, unknown or other
atccaactcaaaacaaaccgttggaggctcatcgttcctattcccccccccccccccccccccccccccaggcagatgttatcgaggtccgacnnnnnnaaaccctacttctcaaaaa

SEQ ID NO: 1255 - DNA, 118 bp, Artificial Sequence
  Description of Artificial Sequence: Synthetic polynucleotide
  modified_base (96)..(101): a, c, t, g, unknown or other
acttctcaacccaacccgttggaggctcatcgttcctattcccccccccccccccccccccccccccccccaggcagatgttatcgaggtccgacnnnnnncctaccaaccataatca

SEQ ID NO: 1256 - DNA, 118 bp, Artificial Sequence
  Description of Artificial Sequence: Synthetic polynucleotide
  modified_base (88)..(93): a, c, t, g, unknown or other
atacaacctaaataaataaactcccaacacaagttggaggctcatcgttcctattccccccccaggcagatgttatcgaggtccgacnnnnnntcttccacttcccttcttcttaaaa

SEQ ID NO: 1257 - DNA, 118 bp, Artificial Sequence
  Description of Artificial Sequence: Synthetic polynucleotide
  modified_base (94)..(99): a, c, t, g, unknown or other
ctattccaattaccccatttacgttggaggctcatcgttcctattccccccccccccccccccccccccaggcagatgttatcgaggtccgacnnnnnntaccatttcctaaaaacaa

SEQ ID NO: 1258 - DNA, 118 bp, Artificial Sequence
  Description of Artificial Sequence: Synthetic polynucleotide
  modified_base (96)..(101): a, c, t, g, unknown or other
aaactcttcaaaacaaacaagttggaggctcatcgttcctattccccccccccccccccccccccccccccaggcagatgttatcgaggtccgacnnnnnnaaaaacaaacaccccta

SEQ ID NO: 1259 - DNA, 118 bp, Artificial Sequence
  Description of Artificial Sequence: Synthetic polynucleotide
  modified_base (91)..(96): a, c, t, g, unknown or other
tactttttataaatcacaaactcgttggaggctcatcgttcctattccccccccccccccccccccaggcagatgttatcgaggtccgacnnnnnnttcaacaataaacaataactca

SEQ ID NO: 1260 - DNA, 118 bp, Artificial Sequence
  Description of Artificial Sequence: Synthetic polynucleotide
  modified_base (88)..(93): a, c, t, g, unknown or other
acctcactcaatctacttcttgttggaggctcatcgttcctattcccccccccccccccccccaggcagatgttatcgaggtccgacnnnnnnataaaaattattttacccattttat

SEQ ID NO: 1261 - DNA, 118 bp, Artificial Sequence
  Description of Artificial Sequence: Synthetic polynucleotide
  modified_base (92)..(97): a, c, t, g, unknown or other
atctcaaccaacacttaactctaaccctacaagttggaggctcatcgttcctattccccccccccccaggcagatgttatcgaggtccgacnnnnnnttcttttacttctaaatttcc

SEQ ID NO: 1262 - DNA, 118 bp, Artificial Sequence
  Description of Artificial Sequence: Synthetic polynucleotide
  modified_base (86)..(91): a, c, t, g, unknown or other
ctaccatctaacaaacccgttggaggctcatcgttcctattccccccccccccccccccccaggcagatgttatcgaggtccgacnnnnnnaaaactaacaccccctaaacacttact

SEQ ID NO: 1263 - DNA, 118 bp, Artificial Sequence
  Description of Artificial Sequence: Synthetic polynucleotide
  modified_base (91)..(96): a, c, t, g, unknown or other
ctatataccaacaaaatttacagttggaggctcatcgttcctattcccccccccccccccccccccaggcagatgttatcgaggtccgacnnnnnnacttaaaaacatcttaacttaa

SEQ ID NO: 1264 - DNA, 118 bp, Artificial Sequence
  Description of Artificial Sequence: Synthetic polynucleotide
  modified_base (93)..(98): a, c, t, g, unknown or other
taactaaaaacaaaaactccctactagttggaggctcatcgttcctattcccccccccccccccccccaggcagatgttatcgaggtccgacnnnnnnacctttctaaactacaaaaa

SEQ ID NO: 1265 - DNA, 118 bp, Artificial Sequence
  Description of Artificial Sequence: Synthetic polynucleotide
  modified_base (95)..(100): a, c, t, g, unknown or other
atacatttctttcacaaaaatactaaccgttggaggctcatcgttcctattcccccccccccccccccccaggcagatgttatcgaggtccgacnnnnnnacccctcttttccaaaaa

SEQ ID NO: 1266 - DNA, 118 bp, Artificial Sequence
  Description of Artificial Sequence: Synthetic polynucleotide
  modified_base (87)..(92): a, c, t, g, unknown or other
tcccttcctctctaaacttcgttggaggctcatcgttcctattcccccccccccccccccccaggcagatgttatcgaggtccgacnnnnnncttctaaattttataaaatttctttt

SEQ ID NO: 1267 - DNA, 118 bp, Artificial Sequence
  Description of Artificial Sequence: Synthetic polynucleotide
  modified_base (92)..(97): a, c, t, g, unknown or other
ctattcacttttcccttcctccgttggaggctcatcgttcctattccccccccccccccccccccccaggcagatgttatcgaggtccgacnnnnnnaatacaaaaacactacaaaaa

SEQ ID NO: 1268 - DNA, 118 bp, Artificial Sequence
  Description of Artificial Sequence: Synthetic polynucleotide
  modified_base (87)..(92): a, c, t, g, unknown or other
ttctacctccctaaataatctatatacgttggaggctcatcgttcctattccccccccccccaggcagatgttatcgaggtccgacnnnnnnaaaaatcccttctaacccccatccca

SEQ ID NO: 1269 - DNA, 118 bp, Artificial Sequence
  Description of Artificial Sequence: Synthetic polynucleotide
  modified_base (93)..(98): a, c, t, g, unknown or other
ccctctacccacttccctaccgttggaggctcatcgttcctattccccccccccccccccccccccccaggcagatgttatcgaggtccgacnnnnnnaaaaacaaaaactaaaacct

SEQ ID NO: 1270 - DNA, 118 bp, Artificial Sequence
  Description of Artificial Sequence: Synthetic polynucleotide
  modified_base (91)..(96): a, c, t, g, unknown or other
cctcaaccaaaaattaaaatgttggaggctcatcgttcctattcccccccccccccccccccccccaggcagatgttatcgaggtccgacnnnnnnttacaatcaaaaccaaacaaaa

SEQ ID NO: 1271 - DNA, 118 bp, Artificial Sequence
  Description of Artificial Sequence: Synthetic polynucleotide
  modified_base (87)..(92): a, c, t, g, unknown or other
atactactaaacaatatacaatcctttcgttggaggctcatcgttcctattcccccccccccaggcagatgttatcgaggtccgacnnnnnntctaaacttaattttatttataccaa

SEQ ID NO: 1272 - DNA, 118 bp, Artificial Sequence
  Description of Artificial Sequence: Synthetic polynucleotide
  modified_base (89)..(94): a, c, t, g, unknown or other
ccaactccaaacaatcctgttggaggctcatcgttcctattcccccccccccccccccccccccaggcagatgttatcgaggtccgacnnnnnnaaaatttctaatcaacaaatataa

SEQ ID NO: 1273 - DNA, 118 bp, Artificial Sequence
  Description of Artificial Sequence: Synthetic polynucleotide
  modified_base (85)..(90): a, c, t, g, unknown or other
cctaccataccaaaactactccctacctccgttggaggctcatcgttcctattcccccccaggcagatgttatcgaggtccgacnnnnnnaaaattaaaaataataataatttcaatc

SEQ ID NO: 1274 - DNA, 118 bp, Artificial Sequence
  Description of Artificial Sequence: Synthetic polynucleotide
  modified_base (93)..(98): a, c, t, g, unknown or other
attcctcacactcaacccgttggaggctcatcgttcctattcccccccccccccccccccccccccccaggcagatgttatcgaggtccgacnnnnnnaacaactcaaaattaaaaca

SEQ ID NO: 1275 - DNA, 118 bp, Artificial Sequence
  Description of Artificial Sequence: Synthetic polynucleotide
  modified_base (86)..(91): a, c, t, g, unknown or other
attaaactttaactaaccatcaagttggaggctcatcgttcctattcccccccccccccccaggcagatgttatcgaggtccgacnnnnnnatcttaaataatacataactataaaat

SEQ ID NO: 1276 - DNA, 118 bp, Artificial Sequence
  Description of Artificial Sequence: Synthetic polynucleotide
  modified_base (90)..(95): a, c, t, g, unknown or other
ctcctaacctacataaacacagttggaggctcatcgttcctattcccccccccccccccccccccaggcagatgttatcgaggtccgacnnnnnnaaattccaatctatccaataaat

SEQ ID NO: 1277 - DNA, 118 bp, Artificial Sequence
  Description of Artificial Sequence: Synthetic polynucleotide
  modified_base (92)..(97): a, c, t, g, unknown or other
aattatcaattataacatcactctgttggaggctcatcgttcctattccccccccccccccccccccaggcagatgttatcgaggtccgacnnnnnntcaaccaataaaataactacc

SEQ ID NO: 1278 - DNA, 118 bp, Artificial Sequence
  Description of Artificial Sequence: Synthetic polynucleotide
  modified_base (95)..(100): a, c, t, g, unknown or other
ccactcaaaatccataaaccgttggaggctcatcgttcctattcccccccccccccccccccccccccccaggcagatgttatcgaggtccgacnnnnnnacctacctacatactcct

SEQ ID NO: 1279 - DNA, 118 bp, Artificial Sequence
  Description of Artificial Sequence: Synthetic polynucleotide
  modified_base (94)..(99): a, c, t, g, unknown or other
atacccatcacttacccgttggaggctcatcgttcctattcccccccccccccccccccccccccccccaggcagatgttatcgaggtccgacnnnnnntctttctctctttctctct

SEQ ID NO: 1280 - DNA, 118 bp, Artificial Sequence
  Description of Artificial Sequence: Synthetic polynucleotide
  modified_base (91)..(96): a, c, t, g, unknown or other
atttcataaaaaccaaaccaacgttggaggctcatcgttcctattcccccccccccccccccccccaggcagatgttatcgaggtccgacnnnnnnttttcacacaacaataattcaa

SEQ ID NO: 1281 - DNA, 118 bp, Artificial Sequence
  Description of Artificial Sequence: Synthetic polynucleotide
  modified_base (92)..(97): a, c, t, g, unknown or other
atcctaactaatctactaaccaacacctaccgttggaggctcatcgttcctattcccccccccccccaggcagatgttatcgaggtccgacnnnnnntaaatcaaaaccctatacact

SEQ ID NO: 1282 - DNA, 118 bp, Artificial Sequence
  Description of Artificial Sequence: Synthetic polynucleotide
  modified_base (93)..(98): a, c, t, g, unknown or other
tactacatatccaaaaaccttctaaaaattgttggaggctcatcgttcctattcccccccccccccccaggcagatgttatcgaggtccgacnnnnnnatttcctaaccccaaaatcc

SEQ ID NO: 1283 - DNA, 118 bp, Artificial Sequence
  Description of Artificial Sequence: Synthetic polynucleotide
  modified_base (93)..(98): a, c, t, g, unknown or other
tcaactttattaataaattccctttctccctcgttggaggctcatcgttcctattcccccccccccccaggcagatgttatcgaggtccgacnnnnnnaaaaatacccaaatactacc

SEQ ID NO: 1284 - DNA, 118 bp, Artificial Sequence
  Description of Artificial Sequence: Synthetic polynucleotide
  modified_base (94)..(99): a, c, t, g, unknown or other
attcattcatccactcacacactcactcaccgttggaggctcatcgttcctattcccccccccccccccaggcagatgttatcgaggtccgacnnnnnnattcatccactcacccact

SEQ ID NO: 1285 - DNA, 118 bp, Artificial Sequence
  Description of Artificial Sequence: Synthetic polynucleotide
  modified_base (84)..(89): a, c, t, g, unknown or other
acttcacataaaaataaccctgttggaggctcatcgttcctattcccccccccccccccaggcagatgttatcgaggtccgacnnnnnntaaatattacatataacattatacttcct

SEQ ID NO: 1286 - DNA, 118 bp, Artificial Sequence; identical to SEQ ID NO: 291
  Description of Artificial Sequence: Synthetic polynucleotide
  modified_base (94)..(99): a, c, t, g, unknown or other

SEQ ID NO: 1287 - DNA, 118 bp, Artificial Sequence
  Description of Artificial Sequence: Synthetic polynucleotide
  modified_base (92)..(97): a, c, t, g, unknown or other
caataactacctcttctaaataagttggaggctcatcgttcctattcccccccccccccccccccccaggcagatgttatcgaggtccgacnnnnnnaaaaacaacataaaaacctat

SEQ ID NO: 1288 - DNA, 118 bp, Artificial Sequence
  Description of Artificial Sequence: Synthetic polynucleotide
  modified_base (90)..(95): a, c, t, g, unknown or other
acacaatacactaaattcttataaagttggaggctcatcgttcctattcccccccccccccccccaggcagatgttatcgaggtccgacnnnnnnttacaacctttccacaactactt

SEQ ID NO: 1289 - DNA, 118 bp, Artificial Sequence
  Description of Artificial Sequence: Synthetic polynucleotide
  modified_base (87)..(92): a, c, t, g, unknown or other
tatcactcaaccctattaaccaataaacgttggaggctcatcgttcctattcccccccccccaggcagatgttatcgaggtccgacnnnnnnacaccctaaactcattaaaaatccaa

SEQ ID NO: 1290 - DNA, 118 bp, Artificial Sequence
  Description of Artificial Sequence: Synthetic polynucleotide
  modified_base (94)..(99): a, c, t, g, unknown or other
acccacaatccaacccacgttggaggctcatcgttcctattccccccccccccccccccccccccccccaggcagatgttatcgaggtccgacnnnnnnacctccaaatatctcatat

SEQ ID NO: 1291 - DNA, 118 bp, Artificial Sequence
  Description of Artificial Sequence: Synthetic polynucleotide
  modified_base (93)..(98): a, c, t, g, unknown or other
caacctaaataaataaactcccagttggaggctcatcgttcctattccccccccccccccccccccccaggcagatgttatcgaggtccgacnnnnnnacttcccttcttcttaaaaa

SEQ ID NO: 1292 - DNA, 118 bp, Artificial Sequence
  Description of Artificial Sequence: Synthetic polynucleotide
  modified_base (92)..(97): a, c, t, g, unknown or other
aaaaatatcaaatacatctctacgttggaggctcatcgttcctattcccccccccccccccccccccaggcagatgttatcgaggtccgacnnnnnnaacttacttactaaatccaat

SEQ ID NO: 1293 - DNA, 118 bp, Artificial Sequence
  Description of Artificial Sequence: Synthetic polynucleotide
  modified_base (97)..(102): a, c, t, g, unknown or other
caccaaaatataactatttccatacgttggaggctcatcgttcctattccccccccccccccccccccccccaggcagatgttatcgaggtccgacnnnnnntcctacccaaaactcc

SEQ ID NO: 1294 - DNA, 118 bp, Artificial Sequence
  Description of Artificial Sequence: Synthetic polynucleotide
  modified_base (93)..(98): a, c, t, g, unknown or other
aaaccaaactaaaacatcctgttggaggctcatcgttcctattcccccccccccccccccccccccccaggcagatgttatcgaggtccgacnnnnnnaaaaacaatcaaccaacact

SEQ ID NO: 1295 - DNA, 118 bp, Artificial Sequence
  Description of Artificial Sequence: Synthetic polynucleotide
  modified_base (91)..(96): a, c, t, g, unknown or other
accccctactctccctgttggaggctcatcgttcctattcccccccccccccccccccccccccccaggcagatgttatcgaggtccgacnnnnnnaactcacactaataaataaaaa

SEQ ID NO: 1296 - DNA, 118 bp, Artificial Sequence
  Description of Artificial Sequence: Synthetic polynucleotide
  modified_base (91)..(96): a, c, t, g, unknown or other
aaacacataactaccaaccaaaacgttggaggctcatcgttcctattcccccccccccccccccccaggcagatgttatcgaggtccgacnnnnnnataaaatacctcaaccatcaac

SEQ ID NO: 1297 - DNA, 118 bp, Artificial Sequence
  Description of Artificial Sequence: Synthetic polynucleotide
  modified_base (90)..(95): a, c, t, g, unknown or other
ccacttctcaacataaaagttggaggctcatcgttcctattccccccccccccccccccccccccaggcagatgttatcgaggtccgacnnnnnnttaaatcactaactctaccctct

SEQ ID NO: 1298 - DNA, 118 bp, Artificial Sequence
  Description of Artificial Sequence: Synthetic polynucleotide
  modified_base (91)..(96): a, c, t, g, unknown or other
tctataaaccttccaccctctacccgttggaggctcatcgttcctattccccccccccccccccccaggcagatgttatcgaggtccgacnnnnnnaaacacttaaattaattctcaa

SEQ ID NO: 1299 - DNA, 118 bp, Artificial Sequence
  Description of Artificial Sequence: Synthetic polynucleotide
  modified_base (94)..(99): a, c, t, g, unknown or other
ccaaataacccacctcgttggaggctcatcgttcctattccccccccccccccccccccccccccccccaggcagatgttatcgaggtccgacnnnnnnacctcttacaactctatac

SEQ ID NO: 1300 - DNA, 118 bp, Artificial Sequence
  Description of Artificial Sequence: Synthetic polynucleotide
  modified_base (90)..(95): a, c, t, g, unknown or other
aaccaccctaaaactcagttggaggctcatcgttcctattcccccccccccccccccccccccccaggcagatgttatcgaggtccgacnnnnnnaaaaatcttcaacttcactaaaa

SEQ ID NO: 1301 - DNA, 118 bp, Artificial Sequence
  Description of Artificial Sequence: Synthetic polynucleotide
  modified_base (84)..(89): a, c, t, g, unknown or other
acaaaacctccaccccttcacaaaaactaaacgttggaggctcatcgttcctattccccaggcagatgttatcgaggtccgacnnnnnntatcaaccaaaaaccaacaaacaaccaaa

SEQ ID NO: 1302 - DNA, 118 bp, Artificial Sequence
  Description of Artificial Sequence: Synthetic polynucleotide
  modified_base (93)..(98): a, c, t, g, unknown or other
acccacccacactcacgttggaggctcatcgttcctattcccccccccccccccccccccccccccccaggcagatgttatcgaggtccgacnnnnnntcactcccataaaccaacaa

SEQ ID NO: 1303 - DNA, 118 bp, Artificial Sequence
  Description of Artificial Sequence: Synthetic polynucleotide
  modified_base (92)..(97): a, c, t, g, unknown or other
actccatctcttcttacaaaacctaaaaagttggaggctcatcgttcctattcccccccccccccccaggcagatgttatcgaggtccgacnnnnnnttaacccaaaataaaaacaaa

SEQ ID NO: 1304 - DNA, 118 bp, Artificial Sequence
  Description of Artificial Sequence: Synthetic polynucleotide
  modified_base (92)..(97): a, c, t, g, unknown or other
cccaccctctactaaacacaagttggaggctcatcgttcctattcccccccccccccccccccccccaggcagatgttatcgaggtccgacnnnnnntttttcttttctcaataccaa

SEQ ID NO: 1305 - DNA, 118 bp, Artificial Sequence
  Description of Artificial Sequence: Synthetic polynucleotide
  modified_base (92)..(97): a, c, t, g, unknown or other
aaaaatctaaaaatttcccttttcatttcctcgttggaggctcatcgttcctattccccccccccccaggcagatgttatcgaggtccgacnnnnnnaaaacctcctaaaattacaac

SEQ ID NO: 1306 - DNA, 118 bp, Artificial Sequence
  Description of Artificial Sequence: Synthetic polynucleotide
  modified_base (85)..(90): a, c, t, g, unknown or other
atcctaataatacttttaccctatcacctagttggaggctcatcgttcctattcccccccaggcagatgttatcgaggtccgacnnnnnntcccttatttctaaaacactcttacatt

SEQ ID NO: 1307 - DNA, 118 bp, Artificial Sequence
  Description of Artificial Sequence: Synthetic polynucleotide
  modified_base (88)..(93): a, c, t, g, unknown or other
ccaaccaaaaataccacgttggaggctcatcgttcctattcccccccccccccccccccccccaggcagatgttatcgaggtccgacnnnnnnactaaaactattattatctaaactt

SEQ ID NO: 1308 - DNA, 118 bp, Artificial Sequence
  Description of Artificial Sequence: Synthetic polynucleotide
  modified_base (82)..(87): a, c, t, g, unknown or other
acctccccctccacacccacgttggaggctcatcgttcctattccccccccccccccaggcagatgttatcgaggtccgacnnnnnnaaaaatctacaaaaacttcttcttcccttta

SEQ ID NO: 1309 - DNA, 118 bp, Artificial Sequence
  Description of Artificial Sequence: Synthetic polynucleotide
  modified_base (95)..(100): a, c, t, g, unknown or other
ccctctttctaacttctaattgttggaggctcatcgttcctattccccccccccccccccccccccccccaggcagatgttatcgaggtccgacnnnnnnaacaatccaacaacaaaa

SEQ ID NO: 1310 - DNA, 118 bp, Artificial Sequence
  Description of Artificial Sequence: Synthetic polynucleotide
  modified_base (91)..(96): a, c, t, g, unknown or other
aaaacatttttaccatctaacgttggaggctcatcgttcctattccccccccccccccccccccccaggcagatgttatcgaggtccgacnnnnnntaaaaacctaaaattttactct

SEQ ID NO: 1311 - DNA, 118 bp, Artificial Sequence
  Description of Artificial Sequence: Synthetic polynucleotide
  modified_base (85)..(90): a, c, t, g, unknown or other
acctaaattcaaacaattctcctacctcaaccgttggaggctcatcgttcctattcccccaggcagatgttatcgaggtccgacnnnnnnttttatttttattttctaaataaaaatt

SEQ ID NO: 1312 - DNA, 118 bp, Artificial Sequence
  Description of Artificial Sequence: Synthetic polynucleotide
  modified_base (88)..(93): a, c, t, g, unknown or other
aaacacccacacccccatatgttggaggctcatcgttcctattccccccccccccccccccccaggcagatgttatcgaggtccgacnnnnnntcttctttctaaaattttcttcaac

SEQ ID NO: 1313 - DNA, 118 bp, Artificial Sequence
  Description of Artificial Sequence: Synthetic polynucleotide
  modified_base (91)..(96): a, c, t, g, unknown or other
atataaatatatttcctcctccgttggaggctcatcgttcctattcccccccccccccccccccccaggcagatgttatcgaggtccgacnnnnnntcaccatccaaaaacataaaaa

SEQ ID NO: 1314 - DNA, 118 bp, Artificial Sequence
  Description of Artificial Sequence: Synthetic polynucleotide
  modified_base (81)..(86): a, c, t, g, unknown or other
cctctccttccctccctgttggaggctcatcgttcctattccccccccccccccccaggcagatgttatcgaggtccgacnnnnnnaaaacaaaactccacaaataaaaacaaaaact

SEQ ID NO: 1315 - DNA, 118 bp, Artificial Sequence
  Description of Artificial Sequence: Synthetic polynucleotide
  modified_base (88)..(93): a, c, t, g, unknown or other
atttttaaacaaccaacaactaaaaccaaaaagttggaggctcatcgttcctattccccccccaggcagatgttatcgaggtccgacnnnnnntctaattctctataaatcttaccat

SEQ ID NO: 1316 - DNA, 118 bp, Artificial Sequence
  Description of Artificial Sequence: Synthetic polynucleotide
  modified_base (93)..(98): a, c, t, g, unknown or other
ctaaaaatttcccttttcattgttggaggctcatcgttcctattccccccccccccccccccccccccaggcagatgttatcgaggtccgacnnnnnnaaaacctcctaaaattacaa

SEQ ID NO: 1317 - DNA, 118 bp, Artificial Sequence
  Description of Artificial Sequence: Synthetic polynucleotide
  modified_base (92)..(97): a, c, t, g, unknown or other
caatttcttaactcacaacctccgttggaggctcatcgttcctattcccccccccccccccccccccaggcagatgttatcgaggtccgacnnnnnnatacaacaatttttctcatac

SEQ ID NO: 1318 - DNA, 118 bp, Artificial Sequence
  Description of Artificial Sequence: Synthetic polynucleotide
  modified_base (84)..(89): a, c, t, g, unknown or other
ttctttacacctttctcatatcctttccgttggaggctcatcgttcctattccccccccaggcagatgttatcgaggtccgacnnnnnnattccaaccctaccttccctacctaaaaa

SEQ ID NO: 1319 - DNA, 118 bp, Artificial Sequence
  Description of Artificial Sequence: Synthetic polynucleotide
  modified_base (95)..(100): a, c, t, g, unknown or other
attaacctcaacctttctgttggaggctcatcgttcctattcccccccccccccccccccccccccccccaggcagatgttatcgaggtccgacnnnnnntcaacttctattcctcaa

SEQ ID NO: 1320 - DNA, 118 bp, Artificial Sequence
  Description of Artificial Sequence: Synthetic polynucleotide
  modified_base (96)..(101): a, c, t, g, unknown or other
aactcctatcctctaacctctacttaactcttgttggaggctcatcgttcctattccccccccccccccccaggcagatgttatcgaggtccgacnnnnnnaaccaaatttcctcctc

SEQ ID NO: 1321 - DNA, 118 bp, Artificial Sequence
  Description of Artificial Sequence: Synthetic polynucleotide
  modified_base (84)..(89): a, c, t, g, unknown or other
aacctccttcacctacacctacccgttggaggctcatcgttcctattccccccccccccaggcagatgttatcgaggtccgacnnnnnntccttttcctactcctacctccctaattt

SEQ ID NO: 1322 - DNA, 118 bp, Artificial Sequence
  Description of Artificial Sequence: Synthetic polynucleotide
  modified_base (94)..(99): a, c, t, g, unknown or other
attcacctcccaattctttacataacttacccgttggaggctcatcgttcctattccccccccccccccaggcagatgttatcgaggtccgacnnnnnntcacttcccaaactaaaaa

SEQ ID NO: 1323 - DNA, 118 bp, Artificial Sequence
  Description of Artificial Sequence: Synthetic polynucleotide
  modified_base (94)..(99): a, c, t, g, unknown or other
accaaatctcctttcctaagttggaggctcatcgttcctattcccccccccccccccccccccccccccaggcagatgttatcgaggtccgacnnnnnnaaatctacccccttcccca

SEQ ID NO: 1324 - DNA, 118 bp, Artificial Sequence
  Description of Artificial Sequence: Synthetic polynucleotide
  modified_base (96)..(101): a, c, t, g, unknown or other
actcccaccccaaatcgttggaggctcatcgttcctattccccccccccccccccccccccccccccccccaggcagatgttatcgaggtccgacnnnnnnctatccctaaacaccac

SEQ ID NO: 1325 - DNA, 118 bp, Artificial Sequence
  Description of Artificial Sequence: Synthetic polynucleotide
  modified_base (97)..(102): a, c, t, g, unknown or other
tcctttaaccaaaacttctataccctaacccgttggaggctcatcgttcctattccccccccccccccccccaggcagatgttatcgaggtccgacnnnnnnacaccctccctccatc

SEQ ID NO: 1326 - DNA, 118 bp, Artificial Sequence
  Description of Artificial Sequence: Synthetic polynucleotide
  modified_base (92)..(97): a, c, t, g, unknown or other
aaactcaaacccaaaatacgttggaggctcatcgttcctattcccccccccccccccccccccccccaggcagatgttatcgaggtccgacnnnnnnttactaaaaactactacaacc

SEQ ID NO: 1327 - DNA, 118 bp, Artificial Sequence
  Description of Artificial Sequence: Synthetic polynucleotide
  modified_base (92)..(97): a, c, t, g, unknown or other
acttctacaaccccaacccaaaattcccaaacgttggaggctcatcgttcctattccccccccccccaggcagatgttatcgaggtccgacnnnnnntttccctcatttaaatacaaa

SEQ ID NO: 1328 - DNA, 118 bp, Artificial Sequence
  Description of Artificial Sequence: Synthetic polynucleotide
  modified_base (95)..(100): a, c, t, g, unknown or other
atatacaacaattctccaaagttggaggctcatcgttcctattcccccccccccccccccccccccccccaggcagatgttatcgaggtccgacnnnnnnaaaaactattctcaccac

SEQ ID NO: 1329 - DNA, 118 bp, Artificial Sequence
  Description of Artificial Sequence: Synthetic polynucleotide
  modified_base (93)..(98): a, c, t, g, unknown or other
ctctaaacacccaaaaacgttggaggctcatcgttcctattcccccccccccccccccccccccccccaggcagatgttatcgaggtccgacnnnnnncaaaaactataaacaaccac

SEQ ID NO: 1330 - DNA, 118 bp, Artificial Sequence
  Description of Artificial Sequence: Synthetic polynucleotide
  modified_base (90)..(95): a, c, t, g, unknown or other
aaactccaccataccccactccacaaagttggaggctcatcgttcctattcccccccccccccccaggcagatgttatcgaggtccgacnnnnnnacaaaaacccctatatatacccc

SEQ ID NO: 1331 - DNA, 118 bp, Artificial Sequence
  Description of Artificial Sequence: Synthetic polynucleotide
  modified_base (90)..(95): a, c, t, g, unknown or other
ttataaacctctctaaccatctttgttggaggctcatcgttcctattccccccccccccccccccaggcagatgttatcgaggtccgacnnnnnntactaaaaactctctaatttacc

SEQ ID NO: 1332 - DNA, 118 bp, Artificial Sequence
  Description of Artificial Sequence: Synthetic polynucleotide
  modified_base (92)..(97): a, c, t, g, unknown or other
caaaaccaaataaaaactccttcccgttggaggctcatcgttcctattcccccccccccccccccccaggcagatgttatcgaggtccgacnnnnnnaaaactaaaacacaaatctac

SEQ ID NO: 1333 - DNA, 118 bp, Artificial Sequence
  Description of Artificial Sequence: Synthetic polynucleotide
  modified_base (91)..(96): a, c, t, g, unknown or other
tcccctacactattaccttaagttggaggctcatcgttcctattccccccccccccccccccccccaggcagatgttatcgaggtccgacnnnnnntaaaaccccttatatatcaatt

SEQ ID NO: 1334 - DNA, 118 bp, Artificial Sequence
  Description of Artificial Sequence: Synthetic polynucleotide
  modified_base (87)..(92): a, c, t, g, unknown or other
tttctaattaacatttctttaaacaatactgttggaggctcatcgttcctattcccccccccaggcagatgttatcgaggtccgacnnnnnnctctaataataaaaccaatataaaaa

SEQ ID NO: 1335 - DNA, 118 bp, Artificial Sequence
  Description of Artificial Sequence: Synthetic polynucleotide
  modified_base (90)..(95): a, c, t, g, unknown or other
caaaactaaaccaaattaaaaccccagttggaggctcatcgttcctattccccccccccccccccaggcagatgttatcgaggtccgacnnnnnntacccaataaaatcctccaaact

SEQ ID NO: 1336 - DNA, 118 bp, Artificial Sequence
  Description of Artificial Sequence: Synthetic polynucleotide
  modified_base (96)..(101): a, c, t, g, unknown or other
aatcactccaaaactaccgttggaggctcatcgttcctattccccccccccccccccccccccccccccccaggcagatgttatcgaggtccgacnnnnnnaaaacctttccttacct

SEQ ID NO: 1337 - DNA, 118 bp, Artificial Sequence
  Description of Artificial Sequence: Synthetic polynucleotide
  modified_base (89)..(94): a, c, t, g, unknown or other
accactaacctcccaaaaccaaaacccacgttggaggctcatcgttcctattccccccccccccaggcagatgttatcgaggtccgacnnnnnntccaacaaaataataataatctta

SEQ ID NO: 1338 - DNA, 118 bp, Artificial Sequence
  Description of Artificial Sequence: Synthetic polynucleotide
  modified_base (86)..(91): a, c, t, g, unknown or other
accccttcaccaacttctaaaacgttggaggctcatcgttcctattcccccccccccccccaggcagatgttatcgaggtccgacnnnnnnatcaccacaaactatacctataaccat

SEQ ID NO: 1339 - DNA, 118 bp, Artificial Sequence
  Description of Artificial Sequence: Synthetic polynucleotide
  modified_base (90)..(95): a, c, t, g, unknown or other
ttaattctctaaccctccttccctaaaagttggaggctcatcgttcctattccccccccccccccaggcagatgttatcgaggtccgacnnnnnnttcaaataactaactaaataccc

SEQ ID NO: 1340 - DNA, 118 bp, Artificial Sequence
  Description of Artificial Sequence: Synthetic polynucleotide
  modified_base (93)..(98): a, c, t, g, unknown or other
acccaatatcctcttaaacgttggaggctcatcgttcctattccccccccccccccccccccccccccaggcagatgttatcgaggtccgacnnnnnncacataaaaacaatacttcc

SEQ ID NO: 1341 - DNA, 118 bp, Artificial Sequence
  Description of Artificial Sequence: Synthetic polynucleotide
  modified_base (94)..(99): a, c, t, g, unknown or other
attctaaaacccctctcgttggaggctcatcgttcctattcccccccccccccccccccccccccccccaggcagatgttatcgaggtccgacnnnnnnactataaccctaaaactcc

SEQ ID NO: 1342 - DNA, 118 bp, Artificial Sequence
  Description of Artificial Sequence: Synthetic polynucleotide
  modified_base (94)..(99): a, c, t, g, unknown or other
aactttttcaataaatacattatcgttggaggctcatcgttcctattccccccccccccccccccccccaggcagatgttatcgaggtccgacnnnnnnaaccacaacccccacaaaa

SEQ ID NO: 1343 - DNA, 118 bp, Artificial Sequence
  Description of Artificial Sequence: Synthetic polynucleotide
  modified_base (96)..(101): a, c, t, g, unknown or other
acttctatatctctccaacaaccgttggaggctcatcgttcctattcccccccccccccccccccccccccaggcagatgttatcgaggtccgacnnnnnntaaacctctcaactccc

SEQ ID NO: 1344 - DNA, 118 bp, Artificial Sequence
  Description of Artificial Sequence: Synthetic polynucleotide
  modified_base (96)..(101): a, c, t, g, unknown or other
acaaaacccttacactccctagttggaggctcatcgttcctattcccccccccccccccccccccccccccaggcagatgttatcgaggtccgacnnnnnntctctaacttcccctca

SEQ ID NO: 1345 - DNA, 118 bp, Artificial Sequence
  Description of Artificial Sequence: Synthetic polynucleotide
  modified_base (94)..(99): a, c, t, g, unknown or other
aactccaccctaaacttttctgttggaggctcatcgttcctattcccccccccccccccccccccccccaggcagatgttatcgaggtccgacnnnnnnactctttatctaacaccac

SEQ ID NO: 1346 - DNA, 118 bp, Artificial Sequence
  Description of Artificial Sequence: Synthetic polynucleotide
  modified_base (92)..(97): a, c, t, g, unknown or other
aaaatctctacactacctaacgttggaggctcatcgttcctattcccccccccccccccccccccccaggcagatgttatcgaggtccgacnnnnnnattaacacaactttacaaaaa

SEQ ID NO: 1347 - DNA, 118 bp, Artificial Sequence
  Description of Artificial Sequence: Synthetic polynucleotide
  modified_base (96)..(101): a, c, t, g, unknown or other
atcactccaaaactaccgttggaggctcatcgttcctattcccccccccccccccccccccccccccccccaggcagatgttatcgaggtccgacnnnnnnaaaacctttccttacct

SEQ ID NO: 1348 - DNA, 118 bp, Artificial Sequence
  Description of Artificial Sequence: Synthetic polynucleotide
  modified_base (93)..(98): a, c, t, g, unknown or other
atacaacaattctccaaactgttggaggctcatcgttcctattcccccccccccccccccccccccccaggcagatgttatcgaggtccgacnnnnnnaaaaactattctcaccactc

SEQ ID NO: 1349 - DNA, 118 bp, Artificial Sequence
  Description of Artificial Sequence: Synthetic polynucleotide
  modified_base (92)..(97): a, c, t, g, unknown or other
atacccatccaaacccgttggaggctcatcgttcctattccccccccccccccccccccccccccccaggcagatgttatcgaggtccgacnnnnnntaataccaaaatcaataacac

SEQ ID NO: 1350 - DNA, 118 bp, Artificial Sequence
  Description of Artificial Sequence: Synthetic polynucleotide
  modified_base (97)..(102): a, c, t, g, unknown or other
caatcttcaaacctcaaacactacgttggaggctcatcgttcctattcccccccccccccccccccccccccaggcagatgttatcgaggtccgacnnnnnntcaacatctcaacacc

SEQ ID NO: 1351 - DNA, 118 bp, Artificial Sequence
  Description of Artificial Sequence: Synthetic polynucleotide
  modified_base (86)..(91): a, c, t, g, unknown or other
actactacacttaaacaaaaagttggaggctcatcgttcctattcccccccccccccccccaggcagatgttatcgaggtccgacnnnnnnttcaaaaactcaaaacacaaaccaaaa

SEQ ID NO: 1352 - DNA, 118 bp, Artificial Sequence
  Description of Artificial Sequence: Synthetic polynucleotide
  modified_base (95)..(100): a, c, t, g, unknown or other
cttctcacacaaaacatacgttggaggctcatcgttcctattccccccccccccccccccccccccccccaggcagatgttatcgaggtccgacnnnnnntcccactaattccatacc

SEQ ID NO: 1353 - DNA, 118 bp, Artificial Sequence
  Description of Artificial Sequence: Synthetic polynucleotide
  modified_base (96)..(101): a, c, t, g, unknown or other
ctacaaattatcatataccaccgttggaggctcatcgttcctattccccccccccccccccccccccccccaggcagatgttatcgaggtccgacnnnnnnctaaaccaatacccctc

SEQ ID NO: 1354 - DNA, 118 bp, Artificial Sequence
  Description of Artificial Sequence: Synthetic polynucleotide
  modified_base (93)..(98): a, c, t, g, unknown or other
cccaacctacctctaagttggaggctcatcgttcctattcccccccccccccccccccccccccccccaggcagatgttatcgaggtccgacnnnnnnccccctccccaccccactaa

SEQ ID NO: 1355 - DNA, 118 bp, Artificial Sequence
  Description of Artificial Sequence: Synthetic polynucleotide
  modified_base (95)..(100): a, c, t, g, unknown or other
ataccactataaataccactgttggaggctcatcgttcctattcccccccccccccccccccccccccccaggcagatgttatcgaggtccgacnnnnnntacaacaaaacatccaac

SEQ ID NO: 1356 - DNA, 118 bp, Artificial Sequence
  Description of Artificial Sequence: Synthetic polynucleotide
  modified_base (91)..(96): a, c, t, g, unknown or other
ctaacctcataatcctccgttggaggctcatcgttcctattcccccccccccccccccccccccccaggcagatgttatcgaggtccgacnnnnnncaaaacaaaactaaataaacaa

SEQ ID NO: 1357 - DNA, 118 bp, Artificial Sequence
  Description of Artificial Sequence: Synthetic polynucleotide
  modified_base (90)..(95): a, c, t, g, unknown or other
atccctcccttccttcaaccaactctgttggaggctcatcgttcctattccccccccccccccccaggcagatgttatcgaggtccgacnnnnnnacaaaaacaaataccattaacta

SEQ ID NO: 1358 - DNA, 118 bp, Artificial Sequence
  Description of Artificial Sequence: Synthetic polynucleotide
  modified_base (96)..(101): a, c, t, g, unknown or other
ctatacaaccatctacccctctgttggaggctcatcgttcctattccccccccccccccccccccccccccaggcagatgttatcgaggtccgacnnnnnntaaacaaacactccctt

SEQ ID NO: 1359 - DNA, 118 bp, Artificial Sequence
  Description of Artificial Sequence: Synthetic polynucleotide
  modified_base (97)..(102): a, c, t, g, unknown or other
acctaaaccaaacctcaaagttggaggctcatcgttcctattccccccccccccccccccccccccccccccaggcagatgttatcgaggtccgacnnnnnnacccattaccacaaac

SEQ ID NO: 1360 - DNA, 118 bp, Artificial Sequence
  Description of Artificial Sequence: Synthetic polynucleotide
  modified_base (93)..(98): a, c, t, g, unknown or other
caacttccactacaaaacgttggaggctcatcgttcctattcccccccccccccccccccccccccccaggcagatgttatcgaggtccgacnnnnnnatctaaaaccaaaacaaaac

SEQ ID NO: 1361 - DNA, 118 bp, Artificial Sequence
  Description of Artificial Sequence: Synthetic polynucleotide
  modified_base (86)..(91): a, c, t, g, unknown or other
ctcaaccaccctcctacccccgttggaggctcatcgttcctattcccccccccccccccccaggcagatgttatcgaggtccgacnnnnnnaccctcctacccccaatactaaacatc

SEQ ID NO: 1362 - DNA, 118 bp, Artificial Sequence
  Description of Artificial Sequence: Synthetic polynucleotide
  modified_base (85)..(90): a, c, t, g, unknown or other
ccctaccccaactcaagttggaggctcatcgttcctattcccccccccccccccccccccaggcagatgttatcgaggtccgacnnnnnntaactctaccctctcctctcctctctac

SEQ ID NO: 1363 - DNA, 118 bp, Artificial Sequence
  Description of Artificial Sequence: Synthetic polynucleotide
  modified_base (89)..(94): a, c, t, g, unknown or other
caacccaaccacaaaacccgttggaggctcatcgttcctattccccccccccccccccccccccaggcagatgttatcgaggtccgacnnnnnnacccacaacccaaccacaaaaccc

SEQ ID NO: 1364 - DNA, 118 bp, Artificial Sequence; identical to SEQ ID NO: 1360
  Description of Artificial Sequence: Synthetic polynucleotide
  modified_base (93)..(98): a, c, t, g, unknown or other

SEQ ID NO: 1365 - DNA, 118 bp, Artificial Sequence
  Description of Artificial Sequence: Synthetic polynucleotide
  modified_base (89)..(94): a, c, t, g, unknown or other
aataactaccatacaaaaccgttggaggctcatcgttcctattcccccccccccccccccccccaggcagatgttatcgaggtccgacnnnnnnaaaacttcttctaaatactatttc

SEQ ID NO: 1366 - DNA, 118 bp, Artificial Sequence
  Description of Artificial Sequence: Synthetic polynucleotide
  modified_base (92)..(97): a, c, t, g, unknown or other
ctccaaatccccaactcgttggaggctcatcgttcctattcccccccccccccccccccccccccccaggcagatgttatcgaggtccgacnnnnnntacctactaaacctaaaaatt

SEQ ID NO: 1367 - DNA, 118 bp, Artificial Sequence
  Description of Artificial Sequence: Synthetic polynucleotide
  modified_base (88)..(93): a, c, t, g, unknown or other
actctaactccaaaaataacgttggaggctcatcgttcctattccccccccccccccccccccaggcagatgttatcgaggtccgacnnnnnnaccatcaaaactcatttaaataatt

SEQ ID NO: 1368 - DNA, 118 bp, Artificial Sequence
  Description of Artificial Sequence: Synthetic polynucleotide
  modified_base (91)..(96): a, c, t, g, unknown or other
aaacaaacaacaaaaacttcgttggaggctcatcgttcctattcccccccccccccccccccccccaggcagatgttatcgaggtccgacnnnnnnactttctcacacttataaaaat

SEQ ID NO: 1369 - DNA, 118 bp, Artificial Sequence
  Description of Artificial Sequence: Synthetic polynucleotide
  modified_base (88)..(93): a, c, t, g, unknown or other
ctaaatccccaaacttccgttggaggctcatcgttcctattccccccccccccccccccccccaggcagatgttatcgaggtccgacnnnnnnaaaaacaacctaatactttaaccta

SEQ ID NO: 1370 - DNA, 118 bp, Artificial Sequence
  Description of Artificial Sequence: Synthetic polynucleotide
  modified_base (89)..(94): a, c, t, g, unknown or other
aaaaaccacctaccaaagttggaggctcatcgttcctattccccccccccccccccccccccccaggcagatgttatcgaggtccgacnnnnnntaaaaattctcctcataactacaa

SEQ ID NO: 1371 - DNA, 118 bp, Artificial Sequence
  Description of Artificial Sequence: Synthetic polynucleotide
  modified_base (93)..(98): a, c, t, g, unknown or other
cccactccctcaaattgttggaggctcatcgttcctattcccccccccccccccccccccccccccccaggcagatgttatcgaggtccgacnnnnnnccattaccaacaaatacctc

SEQ ID NO: 1372 - DNA, 118 bp, Artificial Sequence
  Description of Artificial Sequence: Synthetic polynucleotide
  modified_base (88)..(93): a, c, t, g, unknown or other
cctctctccaataaccaaacccccgttggaggctcatcgttcctattccccccccccccccccaggcagatgttatcgaggtccgacnnnnnnaaataccacaaaacaaccctaaaaa

SEQ ID NO: 1373 - DNA, 118 bp, Artificial Sequence
  Description of Artificial Sequence: Synthetic polynucleotide
  modified_base (92)..(97): a, c, t, g, unknown or other
aaacccacctacaacctcaacctccgttggaggctcatcgttcctattcccccccccccccccccccaggcagatgttatcgaggtccgacnnnnnntaattacaaacttaaaatccc

SEQ ID NO: 1374 - DNA, 118 bp, Artificial Sequence
  Description of Artificial Sequence: Synthetic polynucleotide
  modified_base (95)..(100): a, c, t, g, unknown or other
cccaactacctaactactcttgttggaggctcatcgttcctattccccccccccccccccccccccccccaggcagatgttatcgaggtccgacnnnnnntacaaaaccctaaaaacc

SEQ ID NO: 1375 - DNA, 118 bp, Artificial Sequence
  Description of Artificial Sequence: Synthetic polynucleotide
  modified_base (94)..(99): a, c, t, g, unknown or other
cctcatttacaaataaacctcgttggaggctcatcgttcctattcccccccccccccccccccccccccaggcagatgttatcgaggtccgacnnnnnnacaacctcctccactccat

SEQ ID NO: 1376 - DNA, 118 bp, Artificial Sequence
  Description of Artificial Sequence: Synthetic polynucleotide
  modified_base (90)..(95): a, c, t, g, unknown or other
ctccaaatccccaactcgttggaggctcatcgttcctattcccccccccccccccccccccccccaggcagatgttatcgaggtccgacnnnnnntacctactaaacctaaaaattcc

SEQ ID NO: 1377 - DNA, 118 bp, Artificial Sequence
  Description of Artificial Sequence: Synthetic polynucleotide
  modified_base (96)..(101): a, c, t, g, unknown or other
acactcctccataaaatcgttggaggctcatcgttcctattccccccccccccccccccccccccccccccaggcagatgttatcgaggtccgacnnnnnnacccaaccccaacaccc

SEQ ID NO: 1378 - DNA, 118 bp, Artificial Sequence
  Description of Artificial Sequence: Synthetic polynucleotide
  modified_base (95)..(100): a, c, t, g, unknown or other
aaaaaccaaacccaacgttggaggctcatcgttcctattcccccccccccccccccccccccccccccccaggcagatgttatcgaggtccgacnnnnnnctactcccaccccaaatc

SEQ ID NO: 1379 - DNA, 118 bp, Artificial Sequence
  Description of Artificial Sequence: Synthetic polynucleotide
  modified_base (90)..(95): a, c, t, g, unknown or other
aaataactaaaatcaatcctctgttggaggctcatcgttcctattccccccccccccccccccccaggcagatgttatcgaggtccgacnnnnnncaattaacttttcaaaaacttat

SEQ ID NO: 1380 - DNA, 118 bp, Artificial Sequence
  Description of Artificial Sequence: Synthetic polynucleotide
  modified_base (92)..(97): a, c, t, g, unknown or other
ctaccaaaacttctctacttgttggaggctcatcgttcctattccccccccccccccccccccccccaggcagatgttatcgaggtccgacnnnnnnaaaataaatctatcccaaaac

SEQ ID NO: 1381 - DNA, 118 bp, Artificial Sequence
  Description of Artificial Sequence: Synthetic polynucleotide
  modified_base (94)..(99): a, c, t, g, unknown or other
ccaacaatttcttctactaccgttggaggctcatcgttcctattcccccccccccccccccccccccccaggcagatgttatcgaggtccgacnnnnnnctcctaaaaaccctaaaaa

SEQ ID NO: 1382 - DNA, 118 bp, Artificial Sequence
  Description of Artificial Sequence: Synthetic polynucleotide
  modified_base (89)..(94): a, c, t, g, unknown or other
aaactccccaacaaacaagttggaggctcatcgttcctattcccccccccccccccccccccccaggcagatgttatcgaggtccgacnnnnnnttcataataactcaaaaattaaac

SEQ ID NO: 1383 - DNA, 118 bp, Artificial Sequence
  Description of Artificial Sequence: Synthetic polynucleotide
  modified_base (95)..(100): a, c, t, g, unknown or other
cccaactacctaactactcttccgttggaggctcatcgttcctattccccccccccccccccccccccccaggcagatgttatcgaggtccgacnnnnnntacaaaaccctaaaaacc

SEQ ID NO: 1384 - DNA, 118 bp, Artificial Sequence
  Description of Artificial Sequence: Synthetic polynucleotide
  modified_base (95)..(100): a, c, t, g, unknown or other
aaaccacttatatatactaaaacgttggaggctcatcgttcctattccccccccccccccccccccccccaggcagatgttatcgaggtccgacnnnnnntcacaaacataaaaccaa

SEQ ID NO: 1385 - DNA, 118 bp, Artificial Sequence
  Description of Artificial Sequence: Synthetic polynucleotide
  modified_base (96)..(101): a, c, t, g, unknown or other
acccactttttcaacctgttggaggctcatcgttcctattcccccccccccccccccccccccccccccccaggcagatgttatcgaggtccgacnnnnnncctacctttatcctccc

SEQ ID NO: 1386 - DNA, 118 bp, Artificial Sequence
  Description of Artificial Sequence: Synthetic polynucleotide
  modified_base (88)..(93): a, c, t, g, unknown or other
atttccaccaactcataaaaagttggaggctcatcgttcctattcccccccccccccccccccaggcagatgttatcgaggtccgacnnnnnntaatcctattcctccaattacaact

SEQ ID NO: 1387 - DNA, 118 bp, Artificial Sequence
  Description of Artificial Sequence: Synthetic polynucleotide
  modified_base (95)..(100): a, c, t, g, unknown or other
attttctcccctttttactgttggaggctcatcgttcctattccccccccccccccccccccccccccccaggcagatgttatcgaggtccgacnnnnnntccaaactcaaaacaaaa

SEQ ID NO: 1388 - DNA, 118 bp, Artificial Sequence
  Description of Artificial Sequence: Synthetic polynucleotide
  modified_base (90)..(95): a, c, t, g, unknown or other
atcccctaacccccacgttggaggctcatcgttcctattccccccccccccccccccccccccccaggcagatgttatcgaggtccgacnnnnnnaaaactaaaacccttctcaaaaa

SEQ ID NO: 1389 - DNA, 118 bp, Artificial Sequence
  Description of Artificial Sequence: Synthetic polynucleotide
  modified_base (93)..(98): a, c, t, g, unknown or other
aacaaattcctctaactccctgttggaggctcatcgttcctattccccccccccccccccccccccccaggcagatgttatcgaggtccgacnnnnnnccaaacaacaaactaataaa

SEQ ID NO: 1390 - DNA, 118 bp, Artificial Sequence
  Description of Artificial Sequence: Synthetic polynucleotide
  modified_base (93)..(98): a, c, t, g, unknown or other
ctacaactatataccctataaaagttggaggctcatcgttcctattccccccccccccccccccccccaggcagatgttatcgaggtccgacnnnnnnacctcctcctactacaaaac

SEQ ID NO: 1391 - DNA, 118 bp, Artificial Sequence
  Description of Artificial Sequence: Synthetic polynucleotide
  modified_base (90)..(95): a, c, t, g, unknown or other
tatcttcccttaaaataaccgttggaggctcatcgttcctattccccccccccccccccccccccaggcagatgttatcgaggtccgacnnnnnncaaatccttcaaaatcaaaaaca

SEQ ID NO: 1392 - DNA, 118 bp, Artificial Sequence
  Description of Artificial Sequence: Synthetic polynucleotide
  modified_base (90)..(95): a, c, t, g, unknown or other
aacccctccttccaacgttggaggctcatcgttcctattccccccccccccccccccccccccccaggcagatgttatcgaggtccgacnnnnnnaaaactaaaatcaaaattcataa

SEQ ID NO: 1393 - DNA, 118 bp, Artificial Sequence
  Description of Artificial Sequence: Synthetic polynucleotide
  modified_base (89)..(94): a, c, t, g, unknown or other
accacctactccacttaaagttggaggctcatcgttcctattccccccccccccccccccccccaggcagatgttatcgaggtccgacnnnnnnttctataactctaaaataaatccc

SEQ ID NO: 1394 - DNA, 118 bp, Artificial Sequence
  Description of Artificial Sequence: Synthetic polynucleotide
  modified_base (88)..(93): a, c, t, g, unknown or other
tccataactcaaaacctccgttggaggctcatcgttcctattcccccccccccccccccccccaggcagatgttatcgaggtccgacnnnnnnaaaaacttaattcaaaataactact

SEQ ID NO: 1395 - DNA, 118 bp, Artificial Sequence
  Description of Artificial Sequence: Synthetic polynucleotide
  modified_base (93)..(98): a, c, t, g, unknown or other
caacacaaacacttccgttggaggctcatcgttcctattcccccccccccccccccccccccccccccaggcagatgttatcgaggtccgacnnnnnntaaaccacttatctaccctc

SEQ ID NO: 1396 - DNA, 118 bp, Artificial Sequence
  Description of Artificial Sequence: Synthetic polynucleotide
  modified_base (94)..(99): a, c, t, g, unknown or other
acacaactacttctctctgttggaggctcatcgttcctattccccccccccccccccccccccccccccaggcagatgttatcgaggtccgacnnnnnnaccaatacaaccacatatc

SEQ ID NO: 1397 - DNA, 118 bp, Artificial Sequence
  Description of Artificial Sequence: Synthetic polynucleotide
  modified_base (89)..(94): a, c, t, g, unknown or other
atcctaaaaacaccttctttacaaccccaagttggaggctcatcgttcctattcccccccccccaggcagatgttatcgaggtccgacnnnnnntcttaattattcctctaaataaaa

SEQ ID NO: 1398 - DNA, 118 bp, Artificial Sequence
  Description of Artificial Sequence: Synthetic polynucleotide
  modified_base (92)..(97): a, c, t, g, unknown or other
aaatcaaataataaaatcaaaactagttggaggctcatcgttcctattcccccccccccccccccccaggcagatgttatcgaggtccgacnnnnnnccaaaaactcttctttaaaaa

SEQ ID NO: 1399 - DNA, 118 bp, Artificial Sequence
  Description of Artificial Sequence: Synthetic polynucleotide
  modified_base (86)..(91): a, c, t, g, unknown or other
acaaaactcaacaactttgttggaggctcatcgttcctattccccccccccccccccccccaggcagatgttatcgaggtccgacnnnnnnactattatataaaatacttcataaaac

SEQ ID NO: 1400 - DNA, 118 bp, Artificial Sequence
  Description of Artificial Sequence: Synthetic polynucleotide
  modified_base (96)..(101): a, c, t, g, unknown or other
ctccaaaacaccaactaatctcagttggaggctcatcgttcctattcccccccccccccccccccccccccaggcagatgttatcgaggtccgacnnnnnnacacttaacccaaaact

SEQ ID NO: 1401 - DNA, 118 bp, Artificial Sequence
  Description of Artificial Sequence: Synthetic polynucleotide
  modified_base (93)..(98): a, c, t, g, unknown or other
ttcataaaataccccacataacaataagttggaggctcatcgttcctattccccccccccccccccccaggcagatgttatcgaggtccgacnnnnnnaaactactaaactctaccct

SEQ ID NO: 1402 - DNA, 118 bp, Artificial Sequence
  Description of Artificial Sequence: Synthetic polynucleotide
  modified_base (95)..(100): a, c, t, g, unknown or other
aaaatctccaaaccctccgttggaggctcatcgttcctattcccccccccccccccccccccccccccccaggcagatgttatcgaggtccgacnnnnnncccctactcccctccata

SEQ ID NO: 1403 - DNA, 118 bp, Artificial Sequence
  Description of Artificial Sequence: Synthetic polynucleotide
  modified_base (90)..(95): a, c, t, g, unknown or other
cttcactacacacaaacgttggaggctcatcgttcctattcccccccccccccccccccccccccaggcagatgttatcgaggtccgacnnnnnnataataacaacaatcaccaccac

SEQ ID NO: 1404 - DNA, 118 bp, Artificial Sequence
  Description of Artificial Sequence: Synthetic polynucleotide
  modified_base (92)..(97): a, c, t, g, unknown or other
aaaaccccaaacaacaaaaagttggaggctcatcgttcctattccccccccccccccccccccccccaggcagatgttatcgaggtccgacnnnnnnatctaactacttaaaacctac

SEQ ID NO: 1405 - DNA, 118 bp, Artificial Sequence
  Description of Artificial Sequence: Synthetic polynucleotide
  modified_base (84)..(89): a, c, t, g, unknown or other
acatacccactctatcctcctccctccgttggaggctcatcgttcctattcccccccccaggcagatgttatcgaggtccgacnnnnnntccttccaacttcaccatcaaaattcata

SEQ ID NO: 1406 - DNA, 118 bp, Artificial Sequence
  Description of Artificial Sequence: Synthetic polynucleotide
  modified_base (90)..(95): a, c, t, g, unknown or other
tctcctaccctactccccaaaacatcctcgttggaggctcatcgttcctattcccccccccccccaggcagatgttatcgaggtccgacnnnnnntactaaaccactatttccacaaa

SEQ ID NO: 1407 - DNA, 118 bp, Artificial Sequence
  Description of Artificial Sequence: Synthetic polynucleotide
  modified_base (93)..(98): a, c, t, g, unknown or other
cttcaaacctcaaacactaccagttggaggctcatcgttcctattcccccccccccccccccccccccaggcagatgttatcgaggtccgacnnnnnntacatcaacatctcaacacc

SEQ ID NO: 1408 - DNA, 118 bp, Artificial Sequence
  Description of Artificial Sequence: Synthetic polynucleotide
  modified_base (95)..(100): a, c, t, g, unknown or other
taccaaactataattaaccaacgttggaggctcatcgttcctattcccccccccccccccccccccccccaggcagatgttatcgaggtccgacnnnnnntcccttcaaaaacaaaca

SEQ ID NO: 1409 - DNA, 118 bp, Artificial Sequence
  Description of Artificial Sequence: Synthetic polynucleotide
  modified_base (91)..(96): a, c, t, g, unknown or other
taaacctaattatcactataaacaagttggaggctcatcgttcctattccccccccccccccccccaggcagatgttatcgaggtccgacnnnnnntaataactaactaattcaaacc

SEQ ID NO: 1410 - DNA, 118 bp, Artificial Sequence
  Description of Artificial Sequence: Synthetic polynucleotide
  modified_base (90)..(95): a, c, t, g, unknown or other
taattacaaacttaaaatcccgttggaggctcatcgttcctattcccccccccccccccccccccaggcagatgttatcgaggtccgacnnnnnnaacttattaattacaacctttca

SEQ ID NO: 1411 - DNA, 118 bp, Artificial Sequence
  Description of Artificial Sequence: Synthetic polynucleotide
  modified_base (93)..(98): a, c, t, g, unknown or other
ccaacttccctaaaccgttggaggctcatcgttcctattcccccccccccccccccccccccccccccaggcagatgttatcgaggtccgacnnnnnnaaaactaaaaacactaacca

SEQ ID NO: 1412 - DNA, 118 bp, Artificial Sequence
  Description of Artificial Sequence: Synthetic polynucleotide
  modified_base (90)..(95): a, c, t, g, unknown or other
aaaaacctttccaacacgttggaggctcatcgttcctattcccccccccccccccccccccccccaggcagatgttatcgaggtccgacnnnnnncaaataaaaatcataaatctcaa

SEQ ID NO: 1413 - DNA, 118 bp, Artificial Sequence
  Description of Artificial Sequence: Synthetic polynucleotide
  modified_base (93)..(98): a, c, t, g, unknown or other
ataacaatcaactctttttaaccgttggaggctcatcgttcctattccccccccccccccccccccccaggcagatgttatcgaggtccgacnnnnnnaaaaatcttccaaatcttca

SEQ ID NO: 1414 - DNA, 118 bp, Artificial Sequence
  Description of Artificial Sequence: Synthetic polynucleotide
  modified_base (95)..(100): a, c, t, g, unknown or other
ttccccactccaaaccgttggaggctcatcgttcctattcccccccccccccccccccccccccccccccaggcagatgttatcgaggtccgacnnnnnnccaaccctctcctcctcc

SEQ ID NO: 1415 - DNA, 118 bp, Artificial Sequence
  Description of Artificial Sequence: Synthetic polynucleotide
  modified_base (93)..(98): a, c, t, g, unknown or other
tctcttctcccattaaaagttggaggctcatcgttcctattcccccccccccccccccccccccccccaggcagatgttatcgaggtccgacnnnnnnaccaataaacctttaacttc

SEQ ID NO: 1416 - DNA, 118 bp, Artificial Sequence
  Description of Artificial Sequence: Synthetic polynucleotide
  modified_base (95)..(100): a, c, t, g, unknown or other
cccctaaaataaccaaaaagttggaggctcatcgttcctattccccccccccccccccccccccccccccaggcagatgttatcgaggtccgacnnnnnnaaacctccaactcaaaac

SEQ ID NO: 1417 - DNA, 118 bp, Artificial Sequence
  Description of Artificial Sequence: Synthetic polynucleotide
  modified_base (90)..(95): a, c, t, g, unknown or other
attaatattctcacccccgttggaggctcatcgttcctattccccccccccccccccccccccccaggcagatgttatcgaggtccgacnnnnnnaactaattttaaacctaaaaacc

SEQ ID NO: 1418 - DNA, 118 bp, Artificial Sequence
  Description of Artificial Sequence: Synthetic polynucleotide
  modified_base (96)..(101): a, c, t, g, unknown or other
tctactactcttcatacacgttggaggctcatcgttcctattcccccccccccccccccccccccccccccaggcagatgttatcgaggtccgacnnnnnnccccaatcttcccactt

SEQ ID NO: 1419 - DNA, 118 bp, Artificial Sequence
  Description of Artificial Sequence: Synthetic polynucleotide
  modified_base (94)..(99): a, c, t, g, unknown or other
ttccctcaccaaaaacttaccacgttggaggctcatcgttcctattcccccccccccccccccccccccaggcagatgttatcgaggtccgacnnnnnnaaaactccacttccctcaa

SEQ ID NO: 1420 - DNA, 118 bp, Artificial Sequence
  Description of Artificial Sequence: Synthetic polynucleotide
  modified_base (91)..(96): a, c, t, g, unknown or other
acctctctctttctctcgttggaggctcatcgttcctattccccccccccccccccccccccccccaggcagatgttatcgaggtccgacnnnnnnaattaccataactcctaataac

SEQ ID NO: 1421 - DNA, 118 bp, Artificial Sequence
  Description of Artificial Sequence: Synthetic polynucleotide
  modified_base (89)..(94): a, c, t, g, unknown or other
ctaccaacatccccacgttggaggctcatcgttcctattcccccccccccccccccccccccccaggcagatgttatcgaggtccgacnnnnnnatttaaaaccaacaaacttcccaa

SEQ ID NO: 1422 - DNA, 118 bp, Artificial Sequence
  Description of Artificial Sequence: Synthetic polynucleotide
  modified_base (87)..(92): a, c, t, g, unknown or other
ctttcaacctccaaccgttggaggctcatcgttcctattcccccccccccccccccccccccaggcagatgttatcgaggtccgacnnnnnnacacaacaaaaataatcctaacaaat

SEQ ID NO: 1423 - DNA, 118 bp, Artificial Sequence
  Description of Artificial Sequence: Synthetic polynucleotide
  modified_base (91)..(96): a, c, t, g, unknown or other
aaataacctctaccctacgttggaggctcatcgttcctattcccccccccccccccccccccccccaggcagatgttatcgaggtccgacnnnnnnaaaacaaatttaactttcaaaa

SEQ ID NO: 1424 - DNA, 118 bp, Artificial Sequence
  Description of Artificial Sequence: Synthetic polynucleotide
  modified_base (89)..(94): a, c, t, g, unknown or other
attctccacctcccacgttggaggctcatcgttcctattcccccccccccccccccccccccccaggcagatgttatcgaggtccgacnnnnnnactaactactctttatattaaaaa

SEQ ID NO: 1425 - DNA, 118 bp, Artificial Sequence
  Description of Artificial Sequence: Synthetic polynucleotide
  modified_base (91)..(96): a, c, t, g, unknown or other
acacaaaccaaactccttacacccgttggaggctcatcgttcctattcccccccccccccccccccaggcagatgttatcgaggtccgacnnnnnntaactcaatttaaaaaccataa

SEQ ID NO: 1426 - DNA, 118 bp, Artificial Sequence
  Description of Artificial Sequence: Synthetic polynucleotide
  modified_base (92)..(97): a, c, t, g, unknown or other
ctatacattctacctacaaatccgttggaggctcatcgttcctattcccccccccccccccccccccaggcagatgttatcgaggtccgacnnnnnnacctactacttaaatatttcc

SEQ ID NO: 1427 - DNA, 118 bp, Artificial Sequence
  Description of Artificial Sequence: Synthetic polynucleotide
  modified_base (91)..(96): a, c, t, g, unknown or other
ctacccactcactataacgttggaggctcatcgttcctattcccccccccccccccccccccccccaggcagatgttatcgaggtccgacnnnnnnaaaatccaaatcactctaaaac

SEQ ID NO: 1428 - DNA, 118 bp, Artificial Sequence
  Description of Artificial Sequence: Synthetic polynucleotide
  modified_base (94)..(99): a, c, t, g, unknown or other
accctactctctaattcaaaagttggaggctcatcgttcctattcccccccccccccccccccccccccaggcagatgttatcgaggtccgacnnnnnnaaacaatcacaaacaaaaa

SEQ ID NO: 1429 - DNA, 118 bp, Artificial Sequence
  Description of Artificial Sequence: Synthetic polynucleotide
  modified_base (97)..(102): a, c, t, g, unknown or other
ccaaatctcttctaaaaacttgttggaggctcatcgttcctattccccccccccccccccccccccccccccaggcagatgttatcgaggtccgacnnnnnntccttccctccctacc

SEQ ID NO: 1430 - DNA, 118 bp, Artificial Sequence
  Description of Artificial Sequence: Synthetic polynucleotide
  modified_base (88)..(93): a, c, t, g, unknown or other
accttccctccctaccccaccattgttggaggctcatcgttcctattccccccccccccccccaggcagatgttatcgaggtccgacnnnnnncaataaaaactatactaaactaaac

SEQ ID NO: 1431 - DNA, 118 bp, Artificial Sequence
  Description of Artificial Sequence: Synthetic polynucleotide
  modified_base (87)..(92): a, c, t, g, unknown or other
acccaatttcttccccaactgttggaggctcatcgttcctattcccccccccccccccccccaggcagatgttatcgaggtccgacnnnnnnttaaatctaaaaatctaaacctaaaa

SEQ ID NO: 1432 - DNA, 118 bp, Artificial Sequence
  Description of Artificial Sequence: Synthetic polynucleotide
  modified_base (97)..(102): a, c, t, g, unknown or other
cttacctctccaatacccgttggaggctcatcgttcctattcccccccccccccccccccccccccccccccaggcagatgttatcgaggtccgacnnnnnntccatacccaataccc

SEQ ID NO: 1433 - DNA, 118 bp, Artificial Sequence
  Description of Artificial Sequence: Synthetic polynucleotide
  modified_base (92)..(97): a, c, t, g, unknown or other
accacacttctcaaaccttcactcaagttggaggctcatcgttcctattccccccccccccccccccaggcagatgttatcgaggtccgacnnnnnnaaaaatacacacttctaaaaa

SEQ ID NO: 1434 - DNA, 118 bp, Artificial Sequence
  Description of Artificial Sequence: Synthetic polynucleotide
  modified_base (91)..(96): a, c, t, g, unknown or other
catccttctcacttcctccccaacccgttggaggctcatcgttcctattcccccccccccccccccaggcagatgttatcgaggtccgacnnnnnnactaaaaacctaaaatcaaaaa

SEQ ID NO: 1435 - DNA, 118 bp, Artificial Sequence
  Description of Artificial Sequence: Synthetic polynucleotide
  modified_base (91)..(96): a, c, t, g, unknown or other
aaaccaaaataaaaactactaaagttggaggctcatcgttcctattccccccccccccccccccccaggcagatgttatcgaggtccgacnnnnnntaaaacaaaacaaaaattcctc

SEQ ID NO: 1436 - DNA, 118 bp, Artificial Sequence
  Description of Artificial Sequence: Synthetic polynucleotide
  modified_base (91)..(96): a, c, t, g, unknown or other
accacctaaacaaattacgttggaggctcatcgttcctattcccccccccccccccccccccccccaggcagatgttatcgaggtccgacnnnnnnaaatacaaaaacaccacccaaa

SEQ ID NO: 1437 - DNA, 118 bp, Artificial Sequence
  Description of Artificial Sequence: Synthetic polynucleotide
  modified_base (91)..(96): a, c, t, g, unknown or other
caaacactaaatataaacccgttggaggctcatcgttcctattcccccccccccccccccccccccaggcagatgttatcgaggtccgacnnnnnntcaaaacaaaatacacaataat

SEQ ID NO: 1438 - DNA, 118 bp, Artificial Sequence
  Description of Artificial Sequence: Synthetic polynucleotide
  modified_base (88)..(93): a, c, t, g, unknown or other
atcccttctccaacctcgttggaggctcatcgttcctattcccccccccccccccccccccccaggcagatgttatcgaggtccgacnnnnnntaaactaaaactaaaccacctacca

SEQ ID NO: 1439 - DNA, 118 bp, Artificial Sequence
  Description of Artificial Sequence: Synthetic polynucleotide
  modified_base (91)..(96): a, c, t, g, unknown or other
tctctaaaaatttaattaaaattaaatccaaagttggaggctcatcgttcctattcccccccccccaggcagatgttatcgaggtccgacnnnnnnacccaaatataacattacaaaa

SEQ ID NO: 1440 - DNA, 118 bp, Artificial Sequence
  Description of Artificial Sequence: Synthetic polynucleotide
  modified_base (93)..(98): a, c, t, g, unknown or other
atcatcctccaaacaaagttggaggctcatcgttcctattccccccccccccccccccccccccccccaggcagatgttatcgaggtccgacnnnnnnacttcccaacctaataaaaa

SEQ ID NO: 1441 - DNA, 118 bp, Artificial Sequence
  Description of Artificial Sequence: Synthetic polynucleotide
  modified_base (92)..(97): a, c, t, g, unknown or other
accaccaaacttctctcccaaaatatttctgttggaggctcatcgttcctattccccccccccccccaggcagatgttatcgaggtccgacnnnnnncaataaaaacccaaatatcac

SEQ ID NO: 1442 - DNA, 118 bp, Artificial Sequence
  Description of Artificial Sequence: Synthetic polynucleotide
  modified_base (96)..(101): a, c, t, g, unknown or other
aaaaactcaaaactacccgttggaggctcatcgttcctattccccccccccccccccccccccccccccccaggcagatgttatcgaggtccgacnnnnnnatttcccaaaaaccttc

SEQ ID NO: 1443 - DNA, 118 bp, Artificial Sequence
  Description of Artificial Sequence: Synthetic polynucleotide
  modified_base (91)..(96): a, c, t, g, unknown or other
aatccacttaaccttataacgttggaggctcatcgttcctattcccccccccccccccccccccccaggcagatgttatcgaggtccgacnnnnnnttttattttacctattttcctc

SEQ ID NO: 1444 - DNA, 118 bp, Artificial Sequence
  Description of Artificial Sequence: Synthetic polynucleotide
  modified_base (90)..(95): a, c, t, g, unknown or other
actataaaacttaaacaacaacgttggaggctcatcgttcctattccccccccccccccccccccaggcagatgttatcgaggtccgacnnnnnnaccatacaataactacactcacc

SEQ ID NO: 1445 - DNA, 118 bp, Artificial Sequence
  Description of Artificial Sequence: Synthetic polynucleotide
  modified_base (87)..(92): a, c, t, g, unknown or other
ctaatcaaaaactcatacttttgttggaggctcatcgttcctattcccccccccccccccccaggcagatgttatcgaggtccgacnnnnnnaaattctaaaaccctaccaacttatt

SEQ ID NO: 1446 - DNA, 118 bp, Artificial Sequence
  Description of Artificial Sequence: Synthetic polynucleotide
  modified_base (90)..(95): a, c, t, g, unknown or other
attttctcaacctccccgttggaggctcatcgttcctattcccccccccccccccccccccccccaggcagatgttatcgaggtccgacnnnnnntacactttctcacatctaataaa

SEQ ID NO: 1447 - DNA, 118 bp, Artificial Sequence
  Description of Artificial Sequence: Synthetic polynucleotide
  modified_base (87)..(92): a, c, t, g, unknown or other
tctacactacaacccacctcgttggaggctcatcgttcctattcccccccccccccccccccaggcagatgttatcgaggtccgacnnnnnntcttaaaataaaaactaacacaaaac

SEQ ID NO: 1448 - DNA, 118 bp, Artificial Sequence
  Description of Artificial Sequence: Synthetic polynucleotide
  modified_base (92)..(97): a, c, t, g, unknown or other
aaacctaatatttacttttatacaaagttggaggctcatcgttcctattccccccccccccccccccaggcagatgttatcgaggtccgacnnnnnnttaaatttcttttacttcctc

SEQ ID NO: 1449 - DNA, 118 bp, Artificial Sequence
  Description of Artificial Sequence: Synthetic polynucleotide
  modified_base (92)..(97): a, c, t, g, unknown or other
aaaccaaaataaaaactactaaagttggaggctcatcgttcctattcccccccccccccccccccccaggcagatgttatcgaggtccgacnnnnnnaaaacaaaacaaaaattcctc

SEQ ID NO: 1450 - DNA, 118 bp, Artificial Sequence
  Description of Artificial Sequence: Synthetic polynucleotide
  modified_base (92)..(97): a, c, t, g, unknown or other
aaactacctactaaatactataatccgttggaggctcatcgttcctattccccccccccccccccccaggcagatgttatcgaggtccgacnnnnnntttcctcaacaacattcaaaa

SEQ ID NO: 1451 - DNA, 118 bp, Artificial Sequence
  Description of Artificial Sequence: Synthetic polynucleotide
  modified_base (86)..(91): a, c, t, g, unknown or other
atctaaaccttcttcctccaacttctacctgttggaggctcatcgttcctattccccccccaggcagatgttatcgaggtccgacnnnnnnaaattaaatttatatttttaatcatct

SEQ ID NO: 1452 - DNA, 118 bp, Artificial Sequence
  Description of Artificial Sequence: Synthetic polynucleotide
  modified_base (88)..(93): a, c, t, g, unknown or other
aaacaaatccctctatttatgttggaggctcatcgttcctattccccccccccccccccccccaggcagatgttatcgaggtccgacnnnnnntactataataaaactaacctaaaaa

SEQ ID NO: 1453 - DNA, 118 bp, Artificial Sequence
  Description of Artificial Sequence: Synthetic polynucleotide
  modified_base (97)..(102): a, c, t, g, unknown or other
ccaaacccaaaccaaagttggaggctcatcgttcctattcccccccccccccccccccccccccccccccccaggcagatgttatcgaggtccgacnnnnnnaaaatcacttcctccc

SEQ ID NO: 1454 - DNA, 118 bp, Artificial Sequence
  Description of Artificial Sequence: Synthetic polynucleotide
  modified_base (92)..(97): a, c, t, g, unknown or other
acaaaccctaaactaccgttggaggctcatcgttcctattcccccccccccccccccccccccccccaggcagatgttatcgaggtccgacnnnnnnaccaaaatctactccaacaaa

SEQ ID NO: 1455 - DNA, 118 bp, Artificial Sequence
  Description of Artificial Sequence: Synthetic polynucleotide
  modified_base (94)..(99): a, c, t, g, unknown or other
ccccctaaaaactaaccgttggaggctcatcgttcctattcccccccccccccccccccccccccccccaggcagatgttatcgaggtccgacnnnnnnacaaactataaccaaaacc

SEQ ID NO: 1456 - DNA, 118 bp, Artificial Sequence
  Description of Artificial Sequence: Synthetic polynucleotide
  modified_base (94)..(99): a, c, t, g, unknown or other
aaacttaaaatcaaactacaaaaagttggaggctcatcgttcctattccccccccccccccccccccccaggcagatgttatcgaggtccgacnnnnnntaacccttcttctacaaat

SEQ ID NO: 1457 - DNA, 118 bp, Artificial Sequence
  Description of Artificial Sequence: Synthetic polynucleotide
  modified_base (89)..(94): a, c, t, g, unknown or other
attccccactacaaccgttggaggctcatcgttcctattcccccccccccccccccccccccccaggcagatgttatcgaggtccgacnnnnnnttaaacaaacacaccctaacctaa

SEQ ID NO: 1458 - DNA, 118 bp, Artificial Sequence
  Description of Artificial Sequence: Synthetic polynucleotide
  modified_base (94)..(99): a, c, t, g, unknown or other
acattatcataacaactaacccaaccaaagttggaggctcatcgttcctattcccccccccccccccccaggcagatgttatcgaggtccgacnnnnnnacctaaccttctaacatcc

SEQ ID NO: 1459 - DNA, 118 bp, Artificial Sequence
  Description of Artificial Sequence: Synthetic polynucleotide
  modified_base (87)..(92): a, c, t, g, unknown or other
accccaactaacaaccgttggaggctcatcgttcctattcccccccccccccccccccccccaggcagatgttatcgaggtccgacnnnnnnaccccaacatctctatacacacctaa

SEQ ID NO: 1460 - DNA, 118 bp, Artificial Sequence
  Description of Artificial Sequence: Synthetic polynucleotide
  modified_base (88)..(93): a, c, t, g, unknown or other
attccccactacaacctgttggaggctcatcgttcctattcccccccccccccccccccccccaggcagatgttatcgaggtccgacnnnnnnttaaacaaacacaccctaacctaaa

SEQ ID NO: 1461 - DNA, 118 bp, Artificial Sequence
  Description of Artificial Sequence: Synthetic polynucleotide
  modified_base (87)..(92): a, c, t, g, unknown or other
actataaaacttaaacaacaacgttggaggctcatcgttcctattcccccccccccccccccaggcagatgttatcgaggtccgacnnnnnntaaaccatacaataactacactcacc

SEQ ID NO: 1462 - DNA, 118 bp, Artificial Sequence
  Description of Artificial Sequence: Synthetic polynucleotide
  modified_base (95)..(100): a, c, t, g, unknown or other
aaaaactcctatcctaccgttggaggctcatcgttcctattcccccccccccccccccccccccccccccaggcagatgttatcgaggtccgacnnnnnnaattttcaccttaaccct

SEQ ID NO: 1463 - DNA, 118 bp, Artificial Sequence; identical to SEQ ID NO: 1442
  Description of Artificial Sequence: Synthetic polynucleotide
  modified_base (96)..(101): a, c, t, g, unknown or other

SEQ ID NO: 1464 - DNA, 118 bp, Artificial Sequence
  Description of Artificial Sequence: Synthetic polynucleotide
  modified_base (97)..(102): a, c, t, g, unknown or other
aactcaaccaaatacccgttggaggctcatcgttcctattccccccccccccccccccccccccccccccccaggcagatgttatcgaggtccgacnnnnnnacccttaccaaacccc

SEQ ID NO: 1465 - DNA, 118 bp, Artificial Sequence
  Description of Artificial Sequence: Synthetic polynucleotide
  modified_base (92)..(97): a, c, t, g, unknown or other
acctaaacaccttatccttccgttggaggctcatcgttcctattcccccccccccccccccccccccaggcagatgttatcgaggtccgacnnnnnnaaactaaccaaaacctaaaaa

SEQ ID NO: 1466 - DNA, 118 bp, Artificial Sequence
  Description of Artificial Sequence: Synthetic polynucleotide
  modified_base (94)..(99): a, c, t, g, unknown or other
acaactctctaaaaccaaaaagttggaggctcatcgttcctattcccccccccccccccccccccccccaggcagatgttatcgaggtccgacnnnnnntactcaacttcctctacta

SEQ ID NO: 1467 - DNA, 118 bp, Artificial Sequence; identical to SEQ ID NO: 1455
  Description of Artificial Sequence: Synthetic polynucleotide
  modified_base (94)..(99): a, c, t, g, unknown or other

SEQ ID NO: 1468 - DNA, 118 bp, Artificial Sequence
  Description of Artificial Sequence: Synthetic polynucleotide
  modified_base (85)..(90): a, c, t, g, unknown or other
caaaatccataaacccaacacacgttggaggctcatcgttcctattccccccccccccccaggcagatgttatcgaggtccgacnnnnnntaaaaacaaacaccataaactactaaat

SEQ ID NO: 1469 - DNA, 118 bp, Artificial Sequence
  Description of Artificial Sequence: Synthetic polynucleotide
  modified_base (86)..(91): a, c, t, g, unknown or other
cccccactatcacacacgttggaggctcatcgttcctattcccccccccccccccccccccaggcagatgttatcgaggtccgacnnnnnnttatatttcctcttctcctcttctaaa

SEQ ID NO: 1470 - DNA, 118 bp, Artificial Sequence
  Description of Artificial Sequence: Synthetic polynucleotide
  modified_base (86)..(91): a, c, t, g, unknown or other
ccttcctatttaacccaaaactataaaccgttggaggctcatcgttcctattcccccccccaggcagatgttatcgaggtccgacnnnnnnaaatacccctaccttacctaacccatt

SEQ ID NO: 1471 - DNA, 118 bp, Artificial Sequence
  Description of Artificial Sequence: Synthetic polynucleotide
  modified_base (95)..(100): a, c, t, g, unknown or other
ctaactacctcaaaccatctcccgttggaggctcatcgttcctattccccccccccccccccccccccccaggcagatgttatcgaggtccgacnnnnnnctattcctaaaacaccac

SEQ ID NO: 1472 - DNA, 118 bp, Artificial Sequence
  Description of Artificial Sequence: Synthetic polynucleotide
  modified_base (92)..(97): a, c, t, g, unknown or other
acattattaaacaacactcctaagttggaggctcatcgttcctattcccccccccccccccccccccaggcagatgttatcgaggtccgacnnnnnnaaatataaactccatcctacc

SEQ ID NO: 1473 - DNA, 118 bp, Artificial Sequence
  Description of Artificial Sequence: Synthetic polynucleotide
  modified_base (84)..(89): a, c, t, g, unknown or other
ctacacatcctacctcccgttggaggctcatcgttcctattccccccccccccccccccaggcagatgttatcgaggtccgacnnnnnnacctcatcccctcatttctccttttatac

SEQ ID NO: 1474 - DNA, 118 bp, Artificial Sequence
  Description of Artificial Sequence: Synthetic polynucleotide
  modified_base (90)..(95): a, c, t, g, unknown or other
cctcaaccataaccctgttggaggctcatcgttcctattccccccccccccccccccccccccccaggcagatgttatcgaggtccgacnnnnnncaatatacaaacaaataatactc

SEQ ID NO: 1475 - DNA, 118 bp, Artificial Sequence
  Description of Artificial Sequence: Synthetic polynucleotide
  modified_base (81)..(86): a, c, t, g, unknown or other
ctccaccaccatatccgttggaggctcatcgttcctattcccccccccccccccccaggcagatgttatcgaggtccgacnnnnnnccatttcctaattctctctatatcccctcaaa

SEQ ID NO: 1476 - DNA, 118 bp, Artificial Sequence
  Description of Artificial Sequence: Synthetic polynucleotide
  modified_base (88)..(93): a, c, t, g, unknown or other
cctcaaccataaccctgttggaggctcatcgttcctattccccccccccccccccccccccccaggcagatgttatcgaggtccgacnnnnnncaatatacaaacaaataatactctc

SEQ ID NO: 1477 - DNA, 118 bp, Artificial Sequence
  Description of Artificial Sequence: Synthetic polynucleotide
  modified_base (88)..(93): a, c, t, g, unknown or other
actaccaacccacaaagttggaggctcatcgttcctattccccccccccccccccccccccccaggcagatgttatcgaggtccgacnnnnnntaaacctcccaaaactaaacacctc

SEQ ID NO: 1478 - DNA, 118 bp, Artificial Sequence
  Description of Artificial Sequence: Synthetic polynucleotide
  modified_base (90)..(95): a, c, t, g, unknown or other
accctctattctataaataacaacgttggaggctcatcgttcctattccccccccccccccccccaggcagatgttatcgaggtccgacnnnnnnaaaaacccctcccaaaaataaaa

SEQ ID NO: 1479 - DNA, 118 bp, Artificial Sequence
  Description of Artificial Sequence: Synthetic polynucleotide
  modified_base (81)..(86): a, c, t, g, unknown or other
acccaattatcacaaaaccgttggaggctcatcgttcctattccccccccccccccaggcagatgttatcgaggtccgacnnnnnnactccttccaaaaataaaaataaaaataaaaa

SEQ ID NO: 1480 - DNA, 118 bp, Artificial Sequence
  Description of Artificial Sequence: Synthetic polynucleotide
  modified_base (90)..(95): a, c, t, g, unknown or other
aaaaacaaatataccaactacctaaaagttggaggctcatcgttcctattcccccccccccccccaggcagatgttatcgaggtccgacnnnnnnaccaaatacaatacaaaatatac

SEQ ID NO: 1481 - DNA, 118 bp, Artificial Sequence
  Description of Artificial Sequence: Synthetic polynucleotide
  modified_base (85)..(90): a, c, t, g, unknown or other
actccctttccatataaacctgttggaggctcatcgttcctattccccccccccccccccaggcagatgttatcgaggtccgacnnnnnnaacctttactttctacctctactcaaaa

SEQ ID NO: 1482 - DNA, 118 bp, Artificial Sequence
  Description of Artificial Sequence: Synthetic polynucleotide
  modified_base (88)..(93): a, c, t, g, unknown or other
cctcaaccataaccctacgttggaggctcatcgttcctattccccccccccccccccccccccaggcagatgttatcgaggtccgacnnnnnncaatatacaaacaaataatactctc

SEQ ID NO: 1483 - DNA, 118 bp, Artificial Sequence
  Description of Artificial Sequence: Synthetic polynucleotide
  modified_base (95)..(100): a, c, t, g, unknown or other
aacctttcttcctaaattctttatctgttggaggctcatcgttcctattcccccccccccccccccccccaggcagatgttatcgaggtccgacnnnnnnccctaaaaactctcctac

SEQ ID NO: 1484 - DNA, 118 bp, Artificial Sequence
  Description of Artificial Sequence: Synthetic polynucleotide
  modified_base (89)..(94): a, c, t, g, unknown or other
ctcctaaacaactcaccctagttggaggctcatcgttcctattcccccccccccccccccccccaggcagatgttatcgaggtccgacnnnnnnaaaactatacacactacactaact

SEQ ID NO: 1485 - DNA, 118 bp, Artificial Sequence
  Description of Artificial Sequence: Synthetic polynucleotide
  modified_base (85)..(90): a, c, t, g, unknown or other
cctcctaccttctaacccgttggaggctcatcgttcctattcccccccccccccccccccaggcagatgttatcgaggtccgacnnnnnnttaaacctattaatctctataaattaaa

SEQ ID NO: 1486 - DNA, 118 bp, Artificial Sequence
  Description of Artificial Sequence: Synthetic polynucleotide
  modified_base (92)..(97): a, c, t, g, unknown or other
aaactaaccaccctaaccgttggaggctcatcgttcctattccccccccccccccccccccccccccaggcagatgttatcgaggtccgacnnnnnnaaacctccccaaataataacc

SEQ ID NO: 1487 - DNA, 118 bp, Artificial Sequence
  Description of Artificial Sequence: Synthetic polynucleotide
  modified_base (89)..(94): a, c, t, g, unknown or other
cctcaaccataaccctacgttggaggctcatcgttcctattcccccccccccccccccccccccaggcagatgttatcgaggtccgacnnnnnncaatatacaaacaaataatactct

SEQ ID NO: 1488 - DNA, 118 bp, Artificial Sequence
  Description of Artificial Sequence: Synthetic polynucleotide
  modified_base (96)..(101): a, c, t, g, unknown or other
ataaataacattaaaaacccccaaagttggaggctcatcgttcctattcccccccccccccccccccccccaggcagatgttatcgaggtccgacnnnnnntatcactaccccttacc

SEQ ID NO: 1489 - DNA, 118 bp, Artificial Sequence
  Description of Artificial Sequence: Synthetic polynucleotide
  modified_base (87)..(92): a, c, t, g, unknown or other
ctatcaatatattcttaaaccaatagttggaggctcatcgttcctattccccccccccccccaggcagatgttatcgaggtccgacnnnnnnaaaaattactttcccctaaaaccaaa

SEQ ID NO: 1490 - DNA, 118 bp, Artificial Sequence
  Description of Artificial Sequence: Synthetic polynucleotide
  modified_base (92)..(97): a, c, t, g, unknown or other
acaaaaataataaattatcataattcctcaaagttggaggctcatcgttcctattccccccccccccaggcagatgttatcgaggtccgacnnnnnncaacaattaattacacaaaac

SEQ ID NO: 1491 - DNA, 118 bp, Artificial Sequence
  Description of Artificial Sequence: Synthetic polynucleotide
  modified_base (86)..(91): a, c, t, g, unknown or other
ctctctaactaattctaaaattaagttggaggctcatcgttcctattccccccccccccccaggcagatgttatcgaggtccgacnnnnnntttttcaaataaaatcccacaaatcta

SEQ ID NO: 1492 - DNA, 118 bp, Artificial Sequence; identical to SEQ ID NO: 1487
  Description of Artificial Sequence: Synthetic polynucleotide
  modified_base (89)..(94): a, c, t, g, unknown or other

SEQ ID NO: 1493 - DNA, 118 bp, Artificial Sequence
  Description of Artificial Sequence: Synthetic polynucleotide
  modified_base (92)..(97): a, c, t, g, unknown or other
ccctacaaaaataataaattatcataattcctgttggaggctcatcgttcctattccccccccccccaggcagatgttatcgaggtccgacnnnnnncaacaattaattacacaaaac

SEQ ID NO: 1494 - DNA, 118 bp, Artificial Sequence
  Description of Artificial Sequence: Synthetic polynucleotide
  modified_base (89)..(94): a, c, t, g, unknown or other
acctccaaactctactcctatacgttggaggctcatcgttcctattccccccccccccccccccaggcagatgttatcgaggtccgacnnnnnnctaaatataaaacaattaaaccac

SEQ ID NO: 1495 - DNA, 118 bp, Artificial Sequence
  Description of Artificial Sequence: Synthetic polynucleotide
  modified_base (81)..(86): a, c, t, g, unknown or other
cctcccaaacattaaaccgttggaggctcatcgttcctattcccccccccccccccaggcagatgttatcgaggtccgacnnnnnnaaccaaatcccacacaacctaaaactccaaaa

SEQ ID NO: 1496 - DNA, 118 bp, Artificial Sequence
  Description of Artificial Sequence: Synthetic polynucleotide
  modified_base (85)..(90): a, c, t, g, unknown or other
ctaaaaaccctccacatcaactcctacgttggaggctcatcgttcctattccccccccccaggcagatgttatcgaggtccgacnnnnnnaacaaacttataaataaaatctaataaa

SEQ ID NO: 1497 - DNA, 118 bp, Artificial Sequence
  Description of Artificial Sequence: Synthetic polynucleotide
  modified_base (83)..(88): a, c, t, g, unknown or other
cctacctaaatcacaactaaaactagttggaggctcatcgttcctattccccccccccaggcagatgttatcgaggtccgacnnnnnntttaaaaccaacaaacttcccaacaaaccc

SEQ ID NO: 1498 - DNA, 118 bp, Artificial Sequence
  Description of Artificial Sequence: Synthetic polynucleotide
  modified_base (94)..(99): a, c, t, g, unknown or other
taatacttaataaaatcaacctacgttggaggctcatcgttcctattccccccccccccccccccccccaggcagatgttatcgaggtccgacnnnnnnccaaaacacacacaaaccc

SEQ ID NO: 1499 - DNA, 118 bp, Artificial Sequence
  Description of Artificial Sequence: Synthetic polynucleotide
  modified_base (81)..(86): a, c, t, g, unknown or other
actccctttactcctcccgttggaggctcatcgttcctattcccccccccccccccaggcagatgttatcgaggtccgacnnnnnnaaaacaatcctacaaaatttaaaataaaatat

SEQ ID NO: 1500 - DNA, 118 bp, Artificial Sequence
  Description of Artificial Sequence: Synthetic polynucleotide
  modified_base (94)..(99): a, c, t, g, unknown or other
accttccaaaccatcctaacaaagttggaggctcatcgttcctattcccccccccccccccccccccccaggcagatgttatcgaggtccgacnnnnnnctctcaaactcaaaactac

SEQ ID NO: 1501 - DNA, 118 bp, Artificial Sequence
  Description of Artificial Sequence: Synthetic polynucleotide
  modified_base (88)..(93): a, c, t, g, unknown or other
ctcaaactccccatctcctaaccttttcgttggaggctcatcgttcctattccccccccccccaggcagatgttatcgaggtccgacnnnnnnatctctaaaatcccaaataaaatac

SEQ ID NO: 1502 - DNA, 118 bp, Artificial Sequence
  Description of Artificial Sequence: Synthetic polynucleotide
  modified_base (95)..(100): a, c, t, g, unknown or other
aaaaatttcaatctctaaccaaaaacgttggaggctcatcgttcctattcccccccccccccccccccccaggcagatgttatcgaggtccgacnnnnnntttctcaaatctcaaccc

SEQ ID NO: 1503 - DNA, 118 bp, Artificial Sequence
  Description of Artificial Sequence: Synthetic polynucleotide
  modified_base (88)..(93): a, c, t, g, unknown or other
ctactactactactcctactactaccaagttggaggctcatcgttcctattccccccccccccaggcagatgttatcgaggtccgacnnnnnnttaacatatatatccacaaacactc

SEQ ID NO: 1504 - DNA, 118 bp, Artificial Sequence
  Description of Artificial Sequence: Synthetic polynucleotide
  modified_base (85)..(90): a, c, t, g, unknown or other
aaaaattaaaaatttaaaatacaaaaagttggaggctcatcgttcctattccccccccccaggcagatgttatcgaggtccgacnnnnnnaaaaataaaatccctaaaactacccctt

SEQ ID NO: 1505 - DNA, 118 bp, Artificial Sequence
  Description of Artificial Sequence: Synthetic polynucleotide
  modified_base (95)..(100): a, c, t, g, unknown or other
aaaaactcattaaattaatttaaaaagttggaggctcatcgttcctattcccccccccccccccccccccaggcagatgttatcgaggtccgacnnnnnnacaaccccaaaactaccc

SEQ ID NO: 1506 - DNA, 118 bp, Artificial Sequence
  Description of Artificial Sequence: Synthetic polynucleotide
  modified_base (89)..(94): a, c, t, g, unknown or other
cccttctctaccctcatcactcacgttggaggctcatcgttcctattcccccccccccccccccaggcagatgttatcgaggtccgacnnnnnnaaaaatatattcccatttaaaaac

SEQ ID NO: 1507 - DNA, 118 bp, Artificial Sequence
  Description of Artificial Sequence: Synthetic polynucleotide
  modified_base (90)..(95): a, c, t, g, unknown or other
ctccaccccaccctactccctaataaaaagttggaggctcatcgttcctattcccccccccccccaggcagatgttatcgaggtccgacnnnnnnaaaattaatccatcacaataaaa

SEQ ID NO: 1508 - DNA, 118 bp, Artificial Sequence
  Description of Artificial Sequence: Synthetic polynucleotide
  modified_base (92)..(97): a, c, t, g, unknown or other
ctctataacaaatataaaaataacataatgttggaggctcatcgttcctattcccccccccccccccaggcagatgttatcgaggtccgacnnnnnnttccctaaccataaataaaaa

SEQ ID NO: 1509 - DNA, 118 bp, Artificial Sequence
  Description of Artificial Sequence: Synthetic polynucleotide
  modified_base (87)..(92): a, c, t, g, unknown or other
actctctacaacatcaaaaagttggaggctcatcgttcctattcccccccccccccccccccaggcagatgttatcgaggtccgacnnnnnntcaaaaccatccttaaaaccaaaaac

SEQ ID NO: 1510 - DNA, 118 bp, Artificial Sequence
  Description of Artificial Sequence: Synthetic polynucleotide
  modified_base (94)..(99): a, c, t, g, unknown or other
aaacctacccttctacaaaacctcgttggaggctcatcgttcctattccccccccccccccccccccccaggcagatgttatcgaggtccgacnnnnnnaatacatcccaactccccc

SEQ ID NO: 1511 - DNA, 118 bp, Artificial Sequence
  Description of Artificial Sequence: Synthetic polynucleotide
  modified_base (86)..(91): a, c, t, g, unknown or other
acctcacatttttcaacgttggaggctcatcgttcctattcccccccccccccccccccccaggcagatgttatcgaggtccgacnnnnnnactaaaccctacaaactaacccaaaaa

SEQ ID NO: 1512 - DNA, 118 bp, Artificial Sequence; identical to SEQ ID NO: 1494
  Description of Artificial Sequence: Synthetic polynucleotide
  modified_base (89)..(94): a, c, t, g, unknown or other

SEQ ID NO: 1513 - DNA, 118 bp, Artificial Sequence
  Description of Artificial Sequence: Synthetic polynucleotide
  modified_base (89)..(94): a, c, t, g, unknown or other
actctctaaattctcaataccctcctagttggaggctcatcgttcctattccccccccccccccaggcagatgttatcgaggtccgacnnnnnnactcactaacacatcacaataaat

SEQ ID NO: 1514 - DNA, 118 bp, Artificial Sequence
  Description of Artificial Sequence: Synthetic polynucleotide
  modified_base (90)..(95): a, c, t, g, unknown or other
ccacaaaattacttaaaaacaaaccaaaacttgttggaggctcatcgttcctattccccccccccaggcagatgttatcgaggtccgacnnnnnntacataatcaatatttcacaata

SEQ ID NO: 1515 - DNA, 118 bp, Artificial Sequence
  Description of Artificial Sequence: Synthetic polynucleotide
  modified_base (89)..(94): a, c, t, g, unknown or other
cccatctttcttaataaatctccaacgttggaggctcatcgttcctattcccccccccccccccaggcagatgttatcgaggtccgacnnnnnnatttccctacttccaacaactaat

SEQ ID NO: 1516 - DNA, 118 bp, Artificial Sequence
  Description of Artificial Sequence: Synthetic polynucleotide
  modified_base (95)..(100): a, c, t, g, unknown or other
cccaaatttctaaaccaaaacccgttggaggctcatcgttcctattccccccccccccccccccccccccaggcagatgttatcgaggtccgacnnnnnnaaaacttcctaccctcac

SEQ ID NO: 1517 - DNA, 118 bp, Artificial Sequence
  Description of Artificial Sequence: Synthetic polynucleotide
  modified_base (87)..(92): a, c, t, g, unknown or other
acctaacacaccacttcctccctctccgttggaggctcatcgttcctattccccccccccccaggcagatgttatcgaggtccgacnnnnnnttttctaattctacctatcctaaatt

SEQ ID NO: 1518 - DNA, 118 bp, Artificial Sequence
  Description of Artificial Sequence: Synthetic polynucleotide
  modified_base (95)..(100): a, c, t, g, unknown or other
ccaactatcctacccttaatcgttggaggctcatcgttcctattccccccccccccccccccccccccccaggcagatgttatcgaggtccgacnnnnnncaaaacacctccttctaa

SEQ ID NO: 1519 - DNA, 118 bp, Artificial Sequence
  Description of Artificial Sequence: Synthetic polynucleotide
  modified_base (90)..(95): a, c, t, g, unknown or other
tcccactacctaataacttttctatcttctccgttggaggctcatcgttcctattccccccccccaggcagatgttatcgaggtccgacnnnnnnttctccctaccaatatattttct

SEQ ID NO: 1520 - DNA, 118 bp, Artificial Sequence
  Description of Artificial Sequence: Synthetic polynucleotide
  modified_base (91)..(96): a, c, t, g, unknown or other
tcctacctccctcttccacatttaaaaaccctgttggaggctcatcgttcctattcccccccccccaggcagatgttatcgaggtccgacnnnnnnattacataactaaatccccttt

SEQ ID NO: 1521 - DNA, 118 bp, Artificial Sequence
  Description of Artificial Sequence: Synthetic polynucleotide
  modified_base (97)..(102): a, c, t, g, unknown or other
atccctaaaaattccaaaccactgttggaggctcatcgttcctattccccccccccccccccccccccccccaggcagatgttatcgaggtccgacnnnnnncaatcccacaacatcc

SEQ ID NO: 1522 - DNA, 118 bp, Artificial Sequence
  Description of Artificial Sequence: Synthetic polynucleotide
  modified_base (88)..(93): a, c, t, g, unknown or other
cctctaatcattataacaaacccaaaatacctgttggaggctcatcgttcctattccccccccaggcagatgttatcgaggtccgacnnnnnnaaaactattctttttatataaaact

SEQ ID NO: 1523 - DNA, 118 bp, Artificial Sequence
  Description of Artificial Sequence: Synthetic polynucleotide
  modified_base (89)..(94): a, c, t, g, unknown or other
ctacacataaataaaacctcaaatcctatgttggaggctcatcgttcctattccccccccccccaggcagatgttatcgaggtccgacnnnnnntatcttccctaattatactaaaaa

SEQ ID NO: 1524 - DNA, 118 bp, Artificial Sequence
  Description of Artificial Sequence: Synthetic polynucleotide
  modified_base (85)..(90): a, c, t, g, unknown or other
acctaaaatcaaaaattcaaaactgttggaggctcatcgttcctattcccccccccccccaggcagatgttatcgaggtccgacnnnnnntttattcaaaaacctattaacatacaaa

SEQ ID NO: 1525 - DNA, 118 bp, Artificial Sequence
  Description of Artificial Sequence: Synthetic polynucleotide
  modified_base (94)..(99): a, c, t, g, unknown or other
attatttcctttatatataaatccccaaaagttggaggctcatcgttcctattccccccccccccccccaggcagatgttatcgaggtccgacnnnnnnttctctccatcttcaaaaa

SEQ ID NO: 1526 - DNA, 118 bp, Artificial Sequence
  Description of Artificial Sequence: Synthetic polynucleotide
  modified_base (90)..(95): a, c, t, g, unknown or other
atttaaataaaactacacttaaccctgttggaggctcatcgttcctattccccccccccccccccaggcagatgttatcgaggtccgacnnnnnnccaactaactctcacacctaccc

SEQ ID NO: 1527 - DNA, 118 bp, Artificial Sequence
  Description of Artificial Sequence: Synthetic polynucleotide
  modified_base (82)..(87): a, c, t, g, unknown or other
acaaccacctacccaaacgttggaggctcatcgttcctattccccccccccccccccaggcagatgttatcgaggtccgacnnnnnnattatatcacctacataaaaacaaactacaa

SEQ ID NO: 1528 - DNA, 118 bp, Artificial Sequence
  Description of Artificial Sequence: Synthetic polynucleotide
  modified_base (88)..(93): a, c, t, g, unknown or other
atattaacatcaataacaaccaccacttatgttggaggctcatcgttcctattccccccccccaggcagatgttatcgaggtccgacnnnnnnatacttattaaaacaataacaatta

SEQ ID NO: 1529 - DNA, 118 bp, Artificial Sequence
  Description of Artificial Sequence: Synthetic polynucleotide
  modified_base (85)..(90): a, c, t, g, unknown or other
attcctccaacacaaacaactcgttggaggctcatcgttcctattcccccccccccccccaggcagatgttatcgaggtccgacnnnnnnttcccctctcctccctactactaaccca

SEQ ID NO: 1530 - DNA, 118 bp, Artificial Sequence
  Description of Artificial Sequence: Synthetic polynucleotide
  modified_base (82)..(87): a, c, t, g, unknown or other
ccctccccacacaatccagttggaggctcatcgttcctattccccccccccccccccaggcagatgttatcgaggtccgacnnnnnnaacttaaataacacccaacaactaatctaat

SEQ ID NO: 1531 - DNA, 118 bp, Artificial Sequence
  Description of Artificial Sequence: Synthetic polynucleotide
  modified_base (87)..(92): a, c, t, g, unknown or other
atttaaccaacttatccttacattaacagttggaggctcatcgttcctattcccccccccccaggcagatgttatcgaggtccgacnnnnnnaaaaatattcaccttttaataaaaat

SEQ ID NO: 1532 - DNA, 118 bp, Artificial Sequence
  Description of Artificial Sequence: Synthetic polynucleotide
  modified_base (89)..(94): a, c, t, g, unknown or other
ctaaactcaaataatcctcccacctcaacgttggaggctcatcgttcctattccccccccccccaggcagatgttatcgaggtccgacnnnnnnttctttttcttttcttttcttttt

SEQ ID NO: 1533 - DNA, 118 bp, Artificial Sequence
  Description of Artificial Sequence: Synthetic polynucleotide
  modified_base (87)..(92): a, c, t, g, unknown or other
acactctctattcacattcaccaattaaagttggaggctcatcgttcctattccccccccccaggcagatgttatcgaggtccgacnnnnnnatctttaccttaaaaatcaaaatttt

SEQ ID NO: 1534 - DNA, 118 bp, Artificial Sequence
  Description of Artificial Sequence: Synthetic polynucleotide
  modified_base (84)..(89): a, c, t, g, unknown or other
aaaacctactctctaaacccgttggaggctcatcgttcctattccccccccccccccccaggcagatgttatcgaggtccgacnnnnnntaaaattaaatctaaactcaaaaactcct

SEQ ID NO: 1535 - DNA, 118 bp, Artificial Sequence
  Description of Artificial Sequence: Synthetic polynucleotide
  modified_base (82)..(87): a, c, t, g, unknown or other
cctctaatcccaacactttaaaaagttggaggctcatcgttcctattccccccccccaggcagatgttatcgaggtccgacnnnnnntatttttaatacacttaaaaataaattttaa

SEQ ID NO: 1536 - DNA, 118 bp, Artificial Sequence
  Description of Artificial Sequence: Synthetic polynucleotide
  modified_base (85)..(90): a, c, t, g, unknown or other
accccatctctactaaaaatacaaaagttggaggctcatcgttcctattcccccccccccaggcagatgttatcgaggtccgacnnnnnnattatatctacataactttccctaaaaa

SEQ ID NO: 1537 - DNA, 118 bp, Artificial Sequence
  Description of Artificial Sequence: Synthetic polynucleotide
  modified_base (86)..(91): a, c, t, g, unknown or other
ccttaccctaactctatctcaaacctagttggaggctcatcgttcctattcccccccccccaggcagatgttatcgaggtccgacnnnnnntcaaaaatttatatttacaaaacaaat

SEQ ID NO: 1538 - DNA, 118 bp, Artificial Sequence
  Description of Artificial Sequence: Synthetic polynucleotide
  modified_base (92)..(97): a, c, t, g, unknown or other
actcacacctataatcctaacactttaaaaagttggaggctcatcgttcctattcccccccccccccaggcagatgttatcgaggtccgacnnnnnnaaaaacatacaactttaaaca

SEQ ID NO: 1539 - DNA, 118 bp, Artificial Sequence
  Description of Artificial Sequence: Synthetic polynucleotide
  modified_base (81)..(86): a, c, t, g, unknown or other
ccacaatacaaaccaacgttggaggctcatcgttcctattccccccccccccccccaggcagatgttatcgaggtccgacnnnnnnactactacactaaataaaacaaaaatataaaa

SEQ ID NO: 1540 - DNA, 118 bp, Artificial Sequence
  Description of Artificial Sequence: Synthetic polynucleotide
  modified_base (89)..(94): a, c, t, g, unknown or other
atctttaaaaacaccaatattcatctagttggaggctcatcgttcctattccccccccccccccaggcagatgttatcgaggtccgacnnnnnnaacctcttaaactcaaataatctt

SEQ ID NO: 1541 - DNA, 118 bp, Artificial Sequence
  Description of Artificial Sequence: Synthetic polynucleotide
  modified_base (90)..(95): a, c, t, g, unknown or other
actcccttaaccctctaacttagttggaggctcatcgttcctattccccccccccccccccccccaggcagatgttatcgaggtccgacnnnnnnaaaaacccttctccccaaaccaa

SEQ ID NO: 1542 - DNA, 118 bp, Artificial Sequence
  Description of Artificial Sequence: Synthetic polynucleotide
  modified_base (84)..(89): a, c, t, g, unknown or other
attccccctccaaaccccgttggaggctcatcgttcctattccccccccccccccccccaggcagatgttatcgaggtccgacnnnnnnaccctctaccaatccccacacaactaaca

SEQ ID NO: 1543 - DNA, 118 bp, Artificial Sequence
  Description of Artificial Sequence: Synthetic polynucleotide
  modified_base (82)..(87): a, c, t, g, unknown or other
acttcattccaaaccatcttacagttggaggctcatcgttcctattcccccccccccaggcagatgttatcgaggtccgacnnnnnntttaatttataaaataccatcattttaataa

SEQ ID NO: 1544 - DNA, 118 bp, Artificial Sequence
  Description of Artificial Sequence: Synthetic polynucleotide
  modified_base (81)..(86): a, c, t, g, unknown or other
ccccctctcaacccccgttggaggctcatcgttcctattcccccccccccccccccaggcagatgttatcgaggtccgacnnnnnnttacccaaactaatatcaaactcctaaactca

SEQ ID NO: 1545 - DNA, 118 bp, Artificial Sequence
  Description of Artificial Sequence: Synthetic polynucleotide
  modified_base (88)..(93): a, c, t, g, unknown or other
actaccaaccttatctcacatagttggaggctcatcgttcctattccccccccccccccccccaggcagatgttatcgaggtccgacnnnnnntaaaatacaaaactaaaactttcct

SEQ ID NO: 1546 - DNA, 118 bp, Artificial Sequence
  Description of Artificial Sequence: Synthetic polynucleotide
  modified_base (88)..(93): a, c, t, g, unknown or other
actccatctccaccaacccaaagttggaggctcatcgttcctattccccccccccccccccccaggcagatgttatcgaggtccgacnnnnnntcatcaataaccacaaaaacaaaat

SEQ ID NO: 1547 - DNA, 118 bp, Artificial Sequence
  Description of Artificial Sequence: Synthetic polynucleotide
  modified_base (89)..(94): a, c, t, g, unknown or other
accccactacactcccacctaaatagttggaggctcatcgttcctattccccccccccccccccaggcagatgttatcgaggtccgacnnnnnncctataatcccaactacttaaaaa

SEQ ID NO: 1548 - DNA, 118 bp, Artificial Sequence
  Description of Artificial Sequence: Synthetic polynucleotide
  modified_base (91)..(96): a, c, t, g, unknown or other
cctcttctaacaccccaaaataaccttagttggaggctcatcgttcctattcccccccccccccccaggcagatgttatcgaggtccgacnnnnnnaacaaccacctactaaaacacc

SEQ ID NO: 1549 - DNA, 118 bp, Artificial Sequence
  Description of Artificial Sequence: Synthetic polynucleotide
  modified_base (87)..(92): a, c, t, g, unknown or other
ctacaaatatacattaaaaattcctctaaaatgttggaggctcatcgttcctattcccccccaggcagatgttatcgaggtccgacnnnnnnaaataattttcaaatttattaaaact

SEQ ID NO: 1550 - DNA, 118 bp, Artificial Sequence
  Description of Artificial Sequence: Synthetic polynucleotide
  modified_base (94)..(99): a, c, t, g, unknown or other
attcctcacttccctccacccacgttggaggctcatcgttcctattcccccccccccccccccccccccaggcagatgttatcgaggtccgacnnnnnnaaacttacacccctccacc

SEQ ID NO: 1551 - DNA, 118 bp, Artificial Sequence
  Description of Artificial Sequence: Synthetic polynucleotide
  modified_base (84)..(89): a, c, t, g, unknown or other
atctctcaattacctcaaaaattctataagttggaggctcatcgttcctattcccccccaggcagatgttatcgaggtccgacnnnnnnttcaacctccttaatatttattaatattt

SEQ ID NO: 1552 - DNA, 118 bp, Artificial Sequence
  Description of Artificial Sequence: Synthetic polynucleotide
  modified_base (87)..(92): a, c, t, g, unknown or other
acttccaaaaaccataatcaacaaagttggaggctcatcgttcctattccccccccccccccaggcagatgttatcgaggtccgacnnnnnnttaaaacaaataacaaaaactacaaa

SEQ ID NO: 1553 - DNA, 118 bp, Artificial Sequence
  Description of Artificial Sequence: Synthetic polynucleotide
  modified_base (91)..(96): a, c, t, g, unknown or other
aatttcaataatcacacaaaccaatcagttggaggctcatcgttcctattccccccccccccccccaggcagatgttatcgaggtccgacnnnnnnaaaaatctttctcaacattaaa

SEQ ID NO: 1554 - DNA, 118 bp, Artificial Sequence
  Description of Artificial Sequence: Synthetic polynucleotide
  modified_base (86)..(91): a, c, t, g, unknown or other
acctaacctccttaaacccacgttggaggctcatcgttcctattcccccccccccccccccaggcagatgttatcgaggtccgacnnnnnnctacttaactataaattaacaacaccc

SEQ ID NO: 1555 - DNA, 118 bp, Artificial Sequence
  Description of Artificial Sequence: Synthetic polynucleotide
  modified_base (82)..(87): a, c, t, g, unknown or other
cctccaactcctaatatatactaccgttggaggctcatcgttcctattcccccccccaggcagatgttatcgaggtccgacnnnnnnattctaaaaaccaaaaatctaaaatcaaaat

SEQ ID NO: 1556 - DNA, 118 bp, Artificial Sequence
  Description of Artificial Sequence: Synthetic polynucleotide
  modified_base (94)..(99): a, c, t, g, unknown or other
acaatcaactccacaatctagttggaggctcatcgttcctattccccccccccccccccccccccccccaggcagatgttatcgaggtccgacnnnnnnaatctaacatccccaaaaa

SEQ ID NO: 1557 - DNA, 118 bp, Artificial Sequence
  Description of Artificial Sequence: Synthetic polynucleotide
  modified_base (96)..(101): a, c, t, g, unknown or other
ataccctatccatttccaatacacatagttggaggctcatcgttcctattcccccccccccccccccccccaggcagatgttatcgaggtccgacnnnnnnacttcttaccctctccc

SEQ ID NO: 1558 - DNA, 118 bp, Artificial Sequence
  Description of Artificial Sequence: Synthetic polynucleotide
  modified_base (92)..(97): a, c, t, g, unknown or other
acaattcctcccatccaccctctacgttggaggctcatcgttcctattcccccccccccccccccccaggcagatgttatcgaggtccgacnnnnnnaaactcataataacacaaaaa

SEQ ID NO: 1559 - DNA, 118 bp, Artificial Sequence
  Description of Artificial Sequence: Synthetic polynucleotide
  modified_base (94)..(99): a, c, t, g, unknown or other
actaaaactcctaccccaactctgttggaggctcatcgttcctattcccccccccccccccccccccccaggcagatgttatcgaggtccgacnnnnnncactatttcccatcctaac

SEQ ID NO: 1560 - DNA, 118 bp, Artificial Sequence
  Description of Artificial Sequence: Synthetic polynucleotide
  modified_base (81)..(86): a, c, t, g, unknown or other
atcctcctactttaacctcacaaaagttggaggctcatcgttcctattccccccccaggcagatgttatcgaggtccgacnnnnnnttttaaaattttattttatttttaaaattttt

SEQ ID NO: 1561 - DNA, 118 bp, Artificial Sequence
  Description of Artificial Sequence: Synthetic polynucleotide
  modified_base (84)..(89): a, c, t, g, unknown or other
caataaaaataccaaatacattcacattgttggaggctcatcgttcctattccccccccaggcagatgttatcgaggtccgacnnnnnntttctaattctaaaattctcttaaatatt

SEQ ID NO: 1562 - DNA, 118 bp, Artificial Sequence
  Description of Artificial Sequence: Synthetic polynucleotide
  modified_base (89)..(94): a, c, t, g, unknown or other
atccaatattatcctaacaaacaagttggaggctcatcgttcctattcccccccccccccccccaggcagatgttatcgaggtccgacnnnnnnttttcttcctttttctctaataaa

SEQ ID NO: 1563 - DNA, 118 bp, Artificial Sequence
  Description of Artificial Sequence: Synthetic polynucleotide
  modified_base (94)..(99): a, c, t, g, unknown or other
accaatcaaaaaccaactagttggaggctcatcgttcctattcccccccccccccccccccccccccccaggcagatgttatcgaggtccgacnnnnnncccaaattacactaacaaa

SEQ ID NO: 1564 - DNA, 118 bp, Artificial Sequence
  Description of Artificial Sequence: Synthetic polynucleotide
  modified_base (81)..(86): a, c, t, g, unknown or other
ccctcccacacctaaccccgttggaggctcatcgttcctattccccccccccccccaggcagatgttatcgaggtccgacnnnnnnaatttaatactaataaattcctaaacaaaaat

SEQ ID NO: 1565 - DNA, 118 bp, Artificial Sequence
  Description of Artificial Sequence: Synthetic polynucleotide
  modified_base (93)..(98): a, c, t, g, unknown or other
ctataatcccaacactttaaaaagttggaggctcatcgttcctattccccccccccccccccccccccaggcagatgttatcgaggtccgacnnnnnntccctaaccaaacctaatac

SEQ ID NO: 1566 - DNA, 118 bp, Artificial Sequence
  Description of Artificial Sequence: Synthetic polynucleotide
  modified_base (94)..(99): a, c, t, g, unknown or other
acaataaatcaacctcaaaaagttggaggctcatcgttcctattcccccccccccccccccccccccccaggcagatgttatcgaggtccgacnnnnnnctaactcccttctcctaac

SEQ ID NO: 1567 - DNA, 118 bp, Artificial Sequence
  Description of Artificial Sequence: Synthetic polynucleotide
  modified_base (92)..(97): a, c, t, g, unknown or other
ctaccccacctttctaaaccctaacctcagttggaggctcatcgttcctattcccccccccccccccaggcagatgttatcgaggtccgacnnnnnnatcccccttaatttcctaaaa

SEQ ID NO: 1568 - DNA, 118 bp, Artificial Sequence
  Description of Artificial Sequence: Synthetic polynucleotide
  modified_base (97)..(102): a, c, t, g, unknown or other
attcccctctcccttccctaaagttggaggctcatcgttcctattcccccccccccccccccccccccccccaggcagatgttatcgaggtccgacnnnnnnccaaacaccaaaaccc

SEQ ID NO: 1569 - DNA, 118 bp, Artificial Sequence
  Description of Artificial Sequence: Synthetic polynucleotide
  modified_base (84)..(89): a, c, t, g, unknown or other
atactaatcaaaactcttttcaatattgttggaggctcatcgttcctattcccccccccaggcagatgttatcgaggtccgacnnnnnnttaatactattaatttaataataaaaaca

SEQ ID NO: 1570 - DNA, 118 bp, Artificial Sequence
  Description of Artificial Sequence: Synthetic polynucleotide
  modified_base (94)..(99): a, c, t, g, unknown or other
cttctactattaactaacactcgttggaggctcatcgttcctattccccccccccccccccccccccccaggcagatgttatcgaggtccgacnnnnnnacactctcattaatcctaa

SEQ ID NO: 1571 - DNA, 118 bp, Artificial Sequence
  Description of Artificial Sequence: Synthetic polynucleotide
  modified_base (86)..(91): a, c, t, g, unknown or other
accttacatttctcctctcgttggaggctcatcgttcctattcccccccccccccccccccaggcagatgttatcgaggtccgacnnnnnncccaaactctaaaaccaaaaccaacta

SEQ ID NO: 1572 - DNA, 118 bp, Artificial Sequence
  Description of Artificial Sequence: Synthetic polynucleotide
  modified_base (94)..(99): a, c, t, g, unknown or other
taatacttctattactcacaaattaatctcccgttggaggctcatcgttcctattccccccccccccccaggcagatgttatcgaggtccgacnnnnnnaaaatctctactactcccc

SEQ ID NO: 1573 - DNA, 118 bp, Artificial Sequence
  Description of Artificial Sequence: Synthetic polynucleotide
  modified_base (91)..(96): a, c, t, g, unknown or other
acactcacataacctctccctaccccaaaaagttggaggctcatcgttcctattccccccccccccaggcagatgttatcgaggtccgacnnnnnnttaaatactactcccttttaaa

SEQ ID NO: 1574 - DNA, 118 bp, Artificial Sequence
  Description of Artificial Sequence: Synthetic polynucleotide
  modified_base (88)..(93): a, c, t, g, unknown or other
acacctaactatcaaaactatcaaccgttggaggctcatcgttcctattccccccccccccccaggcagatgttatcgaggtccgacnnnnnnaaacaaaaataaccttcactataat

SEQ ID NO: 1575 - DNA, 118 bp, Artificial Sequence
  Description of Artificial Sequence: Synthetic polynucleotide
  modified_base (88)..(93): a, c, t, g, unknown or other
acacaacaaaatccttttcatattccaatgttggaggctcatcgttcctattcccccccccccaggcagatgttatcgaggtccgacnnnnnnaaaaatttaaattaccctataaaaa

SEQ ID NO: 1576 - DNA, 118 bp, Artificial Sequence
  Description of Artificial Sequence: Synthetic polynucleotide
  modified_base (85)..(90): a, c, t, g, unknown or other
actcaaactccaacctaaacaacatagttggaggctcatcgttcctattcccccccccccaggcagatgttatcgaggtccgacnnnnnnttctaaaaactaactaaacccaaaattt

SEQ ID NO: 1577 - DNA, 118 bp, Artificial Sequence
  Description of Artificial Sequence: Synthetic polynucleotide
  modified_base (86)..(91): a, c, t, g, unknown or other
aaaaacaaccaccaccttcttctacgttggaggctcatcgttcctattcccccccccccccaggcagatgttatcgaggtccgacnnnnnntaacatacaataaaacttactattaac

SEQ ID NO: 1578 - DNA, 118 bp, Artificial Sequence
  Description of Artificial Sequence: Synthetic polynucleotide
  modified_base (85)..(90): a, c, t, g, unknown or other
aaaacctttattctaccctaactcagttggaggctcatcgttcctattccccccccccccaggcagatgttatcgaggtccgacnnnnnnaaaacccccaaattacttcatttaactt

SEQ ID NO: 1579 - DNA, 118 bp, Artificial Sequence
  Description of Artificial Sequence: Synthetic polynucleotide
  modified_base (84)..(89): a, c, t, g, unknown or other
atctatactcccaactcacaaccagttggaggctcatcgttcctattccccccccccccaggcagatgttatcgaggtccgacnnnnnntttttaataaatccatccaacatatctta

SEQ ID NO: 1580 - DNA, 118 bp, Artificial Sequence
  Description of Artificial Sequence: Synthetic polynucleotide
  modified_base (94)..(99): a, c, t, g, unknown or other
acactcacacaaatacatattccacgttggaggctcatcgttcctattcccccccccccccccccccccaggcagatgttatcgaggtccgacnnnnnnaaaaacaatacctcccaaa

SEQ ID NO: 1581 - DNA, 118 bp, Artificial Sequence
  Description of Artificial Sequence: Synthetic polynucleotide
  modified_base (92)..(97): a, c, t, g, unknown or other
accttcaacataaactccaacgttggaggctcatcgttcctattcccccccccccccccccccccccaggcagatgttatcgaggtccgacnnnnnnaacaaaaccttcaaaaaccaa

SEQ ID NO: 1582 - DNA, 118 bp, Artificial Sequence
  Description of Artificial Sequence: Synthetic polynucleotide
  modified_base (91)..(96): a, c, t, g, unknown or other
ctccctaaaacactttcatcctcaaactcagttggaggctcatcgttcctattcccccccccccccaggcagatgttatcgaggtccgacnnnnnnaatctacttcccccacattaaa

SEQ ID NO: 1583 - DNA, 118 bp, Artificial Sequence
  Description of Artificial Sequence: Synthetic polynucleotide
  modified_base (87)..(92): a, c, t, g, unknown or other
accacatttcaccttaaacatttatcaaaccgttggaggctcatcgttcctattccccccccaggcagatgttatcgaggtccgacnnnnnnaaatataacaatataactcaccactt

SEQ ID NO: 1584 - DNA, 118 bp, Artificial Sequence
  Description of Artificial Sequence: Synthetic polynucleotide
  modified_base (87)..(92): a, c, t, g, unknown or other
ataccttcaaatcataaccctacagttggaggctcatcgttcctattcccccccccccccccaggcagatgttatcgaggtccgacnnnnnnatatataatcataaaaatattccaaa

SEQ ID NO: 1585 - DNA, 118 bp, Artificial Sequence
  Description of Artificial Sequence: Synthetic polynucleotide
  modified_base (91)..(96): a, c, t, g, unknown or other
actccacactcaatacacttaaaaacacgttggaggctcatcgttcctattcccccccccccccccaggcagatgttatcgaggtccgacnnnnnnataaatacatacttacacacat

SEQ ID NO: 1586 - DNA, 118 bp, Artificial Sequence
  Description of Artificial Sequence: Synthetic polynucleotide
  modified_base (87)..(92): a, c, t, g, unknown or other
actttccacacaaacctatcctaagttggaggctcatcgttcctattcccccccccccccccaggcagatgttatcgaggtccgacnnnnnnaattataaatcacaaaataattctat

SEQ ID NO: 1587 - DNA, 118 bp, Artificial Sequence
  Description of Artificial Sequence: Synthetic polynucleotide
  modified_base (84)..(89): a, c, t, g, unknown or other
atacacaatctaaaaacaacccaaatctgttggaggctcatcgttcctattccccccccaggcagatgttatcgaggtccgacnnnnnnatattcctattctaataattccctatact

SEQ ID NO: 1588 - DNA, 118 bp, Artificial Sequence
  Description of Artificial Sequence: Synthetic polynucleotide
  modified_base (87)..(92): a, c, t, g, unknown or other
atactacaaaaataataaaacccaccttgttggaggctcatcgttcctattcccccccccccaggcagatgttatcgaggtccgacnnnnnntatttacattaattccccaactaaaa

SEQ ID NO: 1589 - DNA, 118 bp, Artificial Sequence
  Description of Artificial Sequence: Synthetic polynucleotide
  modified_base (93)..(98): a, c, t, g, unknown or other
acttttcaacatcacctaaaaacttaaagttggaggctcatcgttcctattcccccccccccccccccaggcagatgttatcgaggtccgacnnnnnnaaaaatcaccttttcacacc

SEQ ID NO: 1590 - DNA, 118 bp, Artificial Sequence
  Description of Artificial Sequence: Synthetic polynucleotide
  modified_base (90)..(95): a, c, t, g, unknown or other
cctaaaaactaatataaacaaaaccaaagttggaggctcatcgttcctattccccccccccccccaggcagatgttatcgaggtccgacnnnnnnaccaaaccatccttcaaacaccc

SEQ ID NO: 1591 - DNA, 118 bp, Artificial Sequence
  Description of Artificial Sequence: Synthetic polynucleotide
  modified_base (88)..(93): a, c, t, g, unknown or other
cctccttaaaatatctcaaatcctaaaaacagttggaggctcatcgttcctattcccccccccaggcagatgttatcgaggtccgacnnnnnntatcttctctattttaaccatatat

SEQ ID NO: 1592 - DNA, 118 bp, Artificial Sequence
  Description of Artificial Sequence: Synthetic polynucleotide
  modified_base (92)..(97): a, c, t, g, unknown or other
atcccaatcccaacaaaccaaatccactccgttggaggctcatcgttcctattccccccccccccccaggcagatgttatcgaggtccgacnnnnnntccacaatacctataaaaccc

SEQ ID NO: 1593 - DNA, 118 bp, Artificial Sequence
  Description of Artificial Sequence: Synthetic polynucleotide
  modified_base (90)..(95): a, c, t, g, unknown or other
cctccaacttaaactccatctacttccccgttggaggctcatcgttcctattcccccccccccccaggcagatgttatcgaggtccgacnnnnnnaaattcttatacaacttaatacc

SEQ ID NO: 1594 - DNA, 118 bp, Artificial Sequence
  Description of Artificial Sequence: Synthetic polynucleotide
  modified_base (85)..(90): a, c, t, g, unknown or other
aaaactaaacctaaaataacaacgttggaggctcatcgttcctattccccccccccccccaggcagatgttatcgaggtccgacnnnnnnaaaaatttcatttactattttctatcta

SEQ ID NO: 1595 - DNA, 118 bp, Artificial Sequence
  Description of Artificial Sequence: Synthetic polynucleotide
  modified_base (86)..(91): a, c, t, g, unknown or other
acatcccataactatacatttacattgttggaggctcatcgttcctattccccccccccccaggcagatgttatcgaggtccgacnnnnnnaatttaaaccaaatataactctcaatt

SEQ ID NO: 1596 - DNA, 118 bp, Artificial Sequence
  Description of Artificial Sequence: Synthetic polynucleotide
  modified_base (85)..(90): a, c, t, g, unknown or other
acacatactaccatacccaacgttggaggctcatcgttcctattccccccccccccccccaggcagatgttatcgaggtccgacnnnnnntaatataatcaactataatctatcataa

SEQ ID NO: 1597 - DNA, 118 bp, Artificial Sequence
  Description of Artificial Sequence: Synthetic polynucleotide
  modified_base (87)..(92): a, c, t, g, unknown or other
accaccaataccatcaacgttggaggctcatcgttcctattcccccccccccccccccccccaggcagatgttatcgaggtccgacnnnnnntttattttaacctctctaaaccaaaa

SEQ ID NO: 1598 - DNA, 118 bp, Artificial Sequence
  Description of Artificial Sequence: Synthetic polynucleotide
  modified_base (90)..(95): a, c, t, g, unknown or other
ctttctttaacttatctaaacctcatcataccgttggaggctcatcgttcctattccccccccccaggcagatgttatcgaggtccgacnnnnnnaaaaacaatactaattcatcctt

SEQ ID NO: 1599 - DNA, 118 bp, Artificial Sequence
  Description of Artificial Sequence: Synthetic polynucleotide
  modified_base (84)..(89): a, c, t, g, unknown or other
actcactaactttcttccctccgttggaggctcatcgttcctattccccccccccccccaggcagatgttatcgaggtccgacnnnnnnaaaaataacctccaactatattcctaaaa

SEQ ID NO: 1600 - DNA, 118 bp, Artificial Sequence
  Description of Artificial Sequence: Synthetic polynucleotide
  modified_base (91)..(96): a, c, t, g, unknown or other
attttacaacataaaacaaaaatcacaaaagttggaggctcatcgttcctattcccccccccccccaggcagatgttatcgaggtccgacnnnnnntaatacataaaaactcccaatt

SEQ ID NO: 1601 - DNA, 118 bp, Artificial Sequence
  Description of Artificial Sequence: Synthetic polynucleotide
  modified_base (90)..(95): a, c, t, g, unknown or other
acacctcaataataatttcctaacttaatgttggaggctcatcgttcctattcccccccccccccaggcagatgttatcgaggtccgacnnnnnntcccaaaatattaaaattacaaa

SEQ ID NO: 1602 - DNA, 118 bp, Artificial Sequence
  Description of Artificial Sequence: Synthetic polynucleotide
  modified_base (90)..(95): a, c, t, g, unknown or other
ccctaaaataaactctccaatcctaaaacgttggaggctcatcgttcctattcccccccccccccaggcagatgttatcgaggtccgacnnnnnntctaactttcccctaatacactt

SEQ ID NO: 1603 - DNA, 118 bp, Artificial Sequence
  Description of Artificial Sequence: Synthetic polynucleotide
  modified_base (91)..(96): a, c, t, g, unknown or other
attcttaatacaaatacttcaacctgttggaggctcatcgttcctattccccccccccccccccccaggcagatgttatcgaggtccgacnnnnnnaaatcaacaactttcctatact

SEQ ID NO: 1604 - DNA, 118 bp, Artificial Sequence
  Description of Artificial Sequence: Synthetic polynucleotide
  modified_base (90)..(95): a, c, t, g, unknown or other
ctcctcaaaatacctacaaaatccccaagttggaggctcatcgttcctattccccccccccccccaggcagatgttatcgaggtccgacnnnnnnaatcccactcaaaaccattcaaa

SEQ ID NO: 1605 - DNA, 118 bp, Artificial Sequence
  Description of Artificial Sequence: Synthetic polynucleotide
  modified_base (81)..(86): a, c, t, g, unknown or other
tttaaataaccctaaataaaactcgttggaggctcatcgttcctattcccccccccaggcagatgttatcgaggtccgacnnnnnnattactaaacctttttaaaaattctataaaca

SEQ ID NO: 1606 - DNA, 118 bp, Artificial Sequence
  Description of Artificial Sequence: Synthetic polynucleotide
  modified_base (86)..(91): a, c, t, g, unknown or other
aactcaacactaacaaccacgttggaggctcatcgttcctattccccccccccccccccccaggcagatgttatcgaggtccgacnnnnnnacaaaatatttctaaacaccaacactt

SEQ ID NO: 1607 - DNA, 118 bp, Artificial Sequence
  Description of Artificial Sequence: Synthetic polynucleotide
  modified_base (92)..(97): a, c, t, g, unknown or other
acacacaccaaactcacttcttaccaagttggaggctcatcgttcctattcccccccccccccccccaggcagatgttatcgaggtccgacnnnnnntatctacattaccatacaact

SEQ ID NO: 1608 - DNA, 118 bp, Artificial Sequence
  Description of Artificial Sequence: Synthetic polynucleotide
  modified_base (91)..(96): a, c, t, g, unknown or other
ccccactaaactataaactttaaaatcccctagttggaggctcatcgttcctattcccccccccccaggcagatgttatcgaggtccgacnnnnnnaaatctcttaccacttcaaata

SEQ ID NO: 1609 - DNA, 118 bp, Artificial Sequence
  Description of Artificial Sequence: Synthetic polynucleotide
  modified_base (85)..(90): a, c, t, g, unknown or other
ctatcatctactattctctaccgttggaggctcatcgttcctattcccccccccccccccaggcagatgttatcgaggtccgacnnnnnntaaaaactaacctcaaaattcaatcaaa

SEQ ID NO: 1610 - DNA, 118 bp, Artificial Sequence
  Description of Artificial Sequence: Synthetic polynucleotide
  modified_base (83)..(88): a, c, t, g, unknown or other
actccccaattttaaaatacaactaatgttggaggctcatcgttcctattccccccccaggcagatgttatcgaggtccgacnnnnnntacttaaactacttataaatttccacctta

SEQ ID NO: 1611 - DNA, 118 bp, Artificial Sequence
  Description of Artificial Sequence: Synthetic polynucleotide
  modified_base (88)..(93): a, c, t, g, unknown or other
ctactaaacatttctacataataaccactaaagttggaggctcatcgttcctattccccccccaggcagatgttatcgaggtccgacnnnnnntttttctttctattaatattttctt

SEQ ID NO: 1612 - DNA, 118 bp, Artificial Sequence
  Description of Artificial Sequence: Synthetic polynucleotide
  modified_base (90)..(95): a, c, t, g, unknown or other
acctcatcttaaataaaccaaccacttgttggaggctcatcgttcctattcccccccccccccccaggcagatgttatcgaggtccgacnnnnnntacatctttaatctcttactaaa

SEQ ID NO: 1613 - DNA, 118 bp, Artificial Sequence
  Description of Artificial Sequence: Synthetic polynucleotide
  modified_base (88)..(93): a, c, t, g, unknown or other
tccctcctactttaaaaaccaacttcaataacgttggaggctcatcgttcctattccccccccaggcagatgttatcgaggtccgacnnnnnntttctatccttatatttatcataat

SEQ ID NO: 1614 - DNA, 118 bp, Artificial Sequence
  Description of Artificial Sequence: Synthetic polynucleotide
  modified_base (89)..(94): a, c, t, g, unknown or other
acccacacatataattaaacctgttggaggctcatcgttcctattcccccccccccccccccccaggcagatgttatcgaggtccgacnnnnnntaaataacaccatacacaatacaa

SEQ ID NO: 1615 - DNA, 118 bp, Artificial Sequence
  Description of Artificial Sequence: Synthetic polynucleotide
  modified_base (91)..(96): a, c, t, g, unknown or other
atacacctcacaataaaactacccgttggaggctcatcgttcctattcccccccccccccccccccaggcagatgttatcgaggtccgacnnnnnnaaataaaacttcttaaccataa

SEQ ID NO: 1616 - DNA, 118 bp, Artificial Sequence
  Description of Artificial Sequence: Synthetic polynucleotide
  modified_base (86)..(91): a, c, t, g, unknown or other
atctaatcttaactctttcctacctaaaaccgttggaggctcatcgttcctattcccccccaggcagatgttatcgaggtccgacnnnnnntccctacctcttccctaactaaaacct

SEQ ID NO: 1617 - DNA, 118 bp, Artificial Sequence
  Description of Artificial Sequence: Synthetic polynucleotide
  modified_base (89)..(94): a, c, t, g, unknown or other
acacacaacaataatttcccaatcagttggaggctcatcgttcctattccccccccccccccccaggcagatgttatcgaggtccgacnnnnnnaactccatctacctcctaaaaccc

SEQ ID NO: 1618 - DNA, 118 bp, Artificial Sequence
  Description of Artificial Sequence: Synthetic polynucleotide
  modified_base (89)..(94): a, c, t, g, unknown or other
ccattaacctaaaatcaatctaaactatcttgttggaggctcatcgttcctattccccccccccaggcagatgttatcgaggtccgacnnnnnnaaattctaaaaaccaccactctat

SEQ ID NO: 1619 - DNA, 118 bp, Artificial Sequence
  Description of Artificial Sequence: Synthetic polynucleotide
  modified_base (89)..(94): a, c, t, g, unknown or other
ctttaattcaaacctctttttaaaactcgttggaggctcatcgttcctattcccccccccccccaggcagatgttatcgaggtccgacnnnnnntctcaattaatcccttcactttaa

SEQ ID NO: 1620 - DNA, 118 bp, Artificial Sequence
  Description of Artificial Sequence: Synthetic polynucleotide
  modified_base (86)..(91): a, c, t, g, unknown or other
acctttacacatactactcccactaatgttggaggctcatcgttcctattcccccccccccaggcagatgttatcgaggtccgacnnnnnnaaatttttacttaaaaccaatctccct

SEQ ID NO: 1621 - DNA, 118 bp, Artificial Sequence
  Description of Artificial Sequence: Synthetic polynucleotide
  modified_base (90)..(95): a, c, t, g, unknown or other
actcctccccaaaccaaacgttggaggctcatcgttcctattcccccccccccccccccccccccaggcagatgttatcgaggtccgacnnnnnntttctacatctcaaccacaaaaa

SEQ ID NO: 1622 - DNA, 118 bp, Artificial Sequence
  Description of Artificial Sequence: Synthetic polynucleotide
  modified_base (89)..(94): a, c, t, g, unknown or other
atccttctcaacattttccctccgttggaggctcatcgttcctattccccccccccccccccccaggcagatgttatcgaggtccgacnnnnnnaaaactccaaaacttcaaacattt

SEQ ID NO: 1623 - DNA, 118 bp, Artificial Sequence
  Description of Artificial Sequence: Synthetic polynucleotide
  modified_base (92)..(97): a, c, t, g, unknown or other
acaaaatcaaccaaccaacttatcaattgttggaggctcatcgttcctattccccccccccccccccaggcagatgttatcgaggtccgacnnnnnnacttaaaactctccaaacctt

SEQ ID NO: 1624 - DNA, 118 bp, Artificial Sequence
  Description of Artificial Sequence: Synthetic polynucleotide
  modified_base (89)..(94): a, c, t, g, unknown or other
cccaattctcaatcaaaataaaccgttggaggctcatcgttcctattcccccccccccccccccaggcagatgttatcgaggtccgacnnnnnntacttaaaataaaatcttaaccat

SEQ ID NO: 1625 - DNA, 118 bp, Artificial Sequence
  Description of Artificial Sequence: Synthetic polynucleotide
  modified_base (88)..(93): a, c, t, g, unknown or other
actttaaaaaccaaaaataccttaacaagttggaggctcatcgttcctattccccccccccccaggcagatgttatcgaggtccgacnnnnnnacctacctttattaatactaataat

SEQ ID NO: 1626 - DNA, 118 bp, Artificial Sequence
  Description of Artificial Sequence: Synthetic polynucleotide
  modified_base (89)..(94): a, c, t, g, unknown or other
atttatctaacaattaaaactctccacgttggaggctcatcgttcctattccccccccccccccaggcagatgttatcgaggtccgacnnnnnnaataaccaaatcctcctaacaact

SEQ ID NO: 1627 - DNA, 118 bp, Artificial Sequence
  Description of Artificial Sequence: Synthetic polynucleotide
  modified_base (88)..(93): a, c, t, g, unknown or other
atttaaaaccaacctaaccaacataataagttggaggctcatcgttcctattcccccccccccaggcagatgttatcgaggtccgacnnnnnntcatattaatacattacttaaacca

SEQ ID NO: 1628 - DNA, 118 bp, Artificial Sequence
  Description of Artificial Sequence: Synthetic polynucleotide
  modified_base (95)..(100): a, c, t, g, unknown or other
acaaccaacacttaaaaatcaaaacaaaagttggaggctcatcgttcctattccccccccccccccccccaggcagatgttatcgaggtccgacnnnnnntcaaaaaccaaaacacaa

SEQ ID NO: 1629 - DNA, 118 bp, Artificial Sequence
  Description of Artificial Sequence: Synthetic polynucleotide
  modified_base (86)..(91): a, c, t, g, unknown or other
actcctcaaccctaacatcatcacgttggaggctcatcgttcctattccccccccccccccaggcagatgttatcgaggtccgacnnnnnnaaacttaatcaaaaatcctaaatcttt

SEQ ID NO: 1630 - DNA, 118 bp, Artificial Sequence
  Description of Artificial Sequence: Synthetic polynucleotide
  modified_base (88)..(93): a, c, t, g, unknown or other
aacttataaattccttaactcaaatacgttggaggctcatcgttcctattcccccccccccccaggcagatgttatcgaggtccgacnnnnnnatatcacaaattctaaaaaccaaat

SEQ ID NO: 1631 - DNA, 118 bp, Artificial Sequence
  Description of Artificial Sequence: Synthetic polynucleotide
  modified_base (92)..(97): a, c, t, g, unknown or other
ctccaaaaataatcaaaccaaccaaaaagttggaggctcatcgttcctattccccccccccccccccaggcagatgttatcgaggtccgacnnnnnntttcctaaatcaacctcacac

SEQ ID NO: 1632 - DNA, 118 bp, Artificial Sequence
  Description of Artificial Sequence: Synthetic polynucleotide
  modified_base (89)..(94): a, c, t, g, unknown or other
ctcctacaataacactataaaatcaaaatatgttggaggctcatcgttcctattccccccccccaggcagatgttatcgaggtccgacnnnnnntctattcctatattcttaaacaat

SEQ ID NO: 1633 - DNA, 118 bp, Artificial Sequence
  Description of Artificial Sequence: Synthetic polynucleotide
  modified_base (91)..(96): a, c, t, g, unknown or other
acacacacacatcactaaaaacacaagttggaggctcatcgttcctattcccccccccccccccccaggcagatgttatcgaggtccgacnnnnnnaccaccaatatcttcctataca

SEQ ID NO: 1634 - DNA, 118 bp, Artificial Sequence
  Description of Artificial Sequence: Synthetic polynucleotide
  modified_base (86)..(91): a, c, t, g, unknown or other
acccatctcaactttcatcatcaatcctccagttggaggctcatcgttcctattcccccccaggcagatgttatcgaggtccgacnnnnnntccctacatttccctctacactaaaca

SEQ ID NO: 1635 - DNA, 118 bp, Artificial Sequence
  Description of Artificial Sequence: Synthetic polynucleotide
  modified_base (82)..(87): a, c, t, g, unknown or other
ttctaatcactttacccattattcactcgttggaggctcatcgttcctattccccccaggcagatgttatcgaggtccgacnnnnnntttctttttcttcatccatttctctatctat

SEQ ID NO: 1636 - DNA, 118 bp, Artificial Sequence
  Description of Artificial Sequence: Synthetic polynucleotide
  modified_base (86)..(91): a, c, t, g, unknown or other
acacccacccaaaaacaaaaagttggaggctcatcgttcctattcccccccccccccccccaggcagatgttatcgaggtccgacnnnnnnacccaaaatcaaaacttaaaatatttt

SEQ ID NO: 1637 - DNA, 118 bp, Artificial Sequence
  Description of Artificial Sequence: Synthetic polynucleotide
  modified_base (88)..(93): a, c, t, g, unknown or other
ctcccataacattcacctaataaaactaaaagttggaggctcatcgttcctattcccccccccaggcagatgttatcgaggtccgacnnnnnntaccatatcctctactaattacttt

SEQ ID NO: 1638 - DNA, 118 bp, Artificial Sequence
  Description of Artificial Sequence: Synthetic polynucleotide
  modified_base (81)..(86): a, c, t, g, unknown or other
acctcaaaaactctaccataattcacccgttggaggctcatcgttcctattcccccaggcagatgttatcgaggtccgacnnnnnnatattaacttaaaatcacatcactaacccttt

SEQ ID NO: 1639 - DNA, 118 bp, Artificial Sequence
  Description of Artificial Sequence: Synthetic polynucleotide
  modified_base (81)..(86): a, c, t, g, unknown or other
caataccttataataacccctaacttcgttggaggctcatcgttcctattccccccaggcagatgttatcgaggtccgacnnnnnntaactaattaactttcttcatttaattaccct

SEQ ID NO: 1640 - DNA, 118 bp, Artificial Sequence
  Description of Artificial Sequence: Synthetic polynucleotide
  modified_base (87)..(92): a, c, t, g, unknown or other
atcctatacataataaacactaacccagttggaggctcatcgttcctattccccccccccccaggcagatgttatcgaggtccgacnnnnnntacctataataaaccctttaaacaaa

SEQ ID NO: 1641 - DNA, 118 bp, Artificial Sequence
  Description of Artificial Sequence: Synthetic polynucleotide
  modified_base (86)..(91): a, c, t, g, unknown or other
attcccataaaaactactccctcaagttggaggctcatcgttcctattcccccccccccccaggcagatgttatcgaggtccgacnnnnnnaaaaatatattaccttcatcctaacta

SEQ ID NO: 1642 - DNA, 118 bp, Artificial Sequence
  Description of Artificial Sequence: Synthetic polynucleotide
  modified_base (90)..(95): a, c, t, g, unknown or other
ccatattacccaaacttctcacaaactcccgttggaggctcatcgttcctattccccccccccccaggcagatgttatcgaggtccgacnnnnnnaacctcccaaataactaaatcca

SEQ ID NO: 1643 - DNA, 118 bp, Artificial Sequence
  Description of Artificial Sequence: Synthetic polynucleotide
  modified_base (83)..(88): a, c, t, g, unknown or other
actctactaaactccaacaccagttggaggctcatcgttcctattcccccccccccccaggcagatgttatcgaggtccgacnnnnnnatatacaatatcttaccccttcaaataact

SEQ ID NO: 1644 - DNA, 118 bp, Artificial Sequence
  Description of Artificial Sequence: Synthetic polynucleotide
  modified_base (88)..(93): a, c, t, g, unknown or other
atccaaacccttaaacaccttcttctgttggaggctcatcgttcctattccccccccccccccaggcagatgttatcgaggtccgacnnnnnnataaaaacaatcacttccaaatctt

SEQ ID NO: 1645 - DNA, 118 bp, Artificial Sequence
  Description of Artificial Sequence: Synthetic polynucleotide
  modified_base (85)..(90): a, c, t, g, unknown or other
acctcttattcattccccttaagttggaggctcatcgttcctattcccccccccccccccaggcagatgttatcgaggtccgacnnnnnntacaaatactctctcaaaaactataaaa

SEQ ID NO: 1646 - DNA, 118 bp, Artificial Sequence
  Description of Artificial Sequence: Synthetic polynucleotide
  modified_base (94)..(99): a, c, t, g, unknown or other
acacctattacacaacttataaatcgttggaggctcatcgttcctattcccccccccccccccccccccaggcagatgttatcgaggtccgacnnnnnnacaaccacaatcaaaacaa

SEQ ID NO: 1647 - DNA, 118 bp, Artificial Sequence
  Description of Artificial Sequence: Synthetic polynucleotide
  modified_base (89)..(94): a, c, t, g, unknown or other
cttctataactaatctccttcccttactacgttggaggctcatcgttcctattcccccccccccaggcagatgttatcgaggtccgacnnnnnntaaaatcctactacaaacattaat

SEQ ID NO: 1648 - DNA, 118 bp, Artificial Sequence
  Description of Artificial Sequence: Synthetic polynucleotide
  modified_base (89)..(94): a, c, t, g, unknown or other
acttccctactaaaatactcccgttggaggctcatcgttcctattcccccccccccccccccccaggcagatgttatcgaggtccgacnnnnnntactaaaacatccctccctaaaaa

SEQ ID NO: 1649 - DNA, 118 bp, Artificial Sequence
  Description of Artificial Sequence: Synthetic polynucleotide
  modified_base (86)..(91): a, c, t, g, unknown or other
atcccctcctaaaaacacactcctaaacctgttggaggctcatcgttcctattccccccccaggcagatgttatcgaggtccgacnnnnnnatatccaaattccacccctttaccaat

SEQ ID NO: 1650 - DNA, 118 bp, Artificial Sequence
  Description of Artificial Sequence: Synthetic polynucleotide
  modified_base (94)..(99): a, c, t, g, unknown or other
atattaataaaaataaaaatttcaccatctgttggaggctcatcgttcctattccccccccccccccccaggcagatgttatcgaggtccgacnnnnnntctacctcccaaattcaaa

SEQ ID NO: 1651 - DNA, 118 bp, Artificial Sequence
  Description of Artificial Sequence: Synthetic polynucleotide
  modified_base (86)..(91): a, c, t, g, unknown or other
atataaaaattattcttcctataaatatacgttggaggctcatcgttcctattccccccccaggcagatgttatcgaggtccgacnnnnnnaaatttaaatatcacctttataaaaca

SEQ ID NO: 1652 - DNA, 118 bp, Artificial Sequence
  Description of Artificial Sequence: Synthetic polynucleotide
  modified_base (85)..(90): a, c, t, g, unknown or other
aaacaaaactactctctaattaagttggaggctcatcgttcctattccccccccccccccaggcagatgttatcgaggtccgacnnnnnntaatctccatcacactcacctctcctct

SEQ ID NO: 1653 - DNA, 118 bp, Artificial Sequence
  Description of Artificial Sequence: Synthetic polynucleotide
  modified_base (94)..(99): a, c, t, g, unknown or other
ataacaaaacaaaccccacacgttggaggctcatcgttcctattcccccccccccccccccccccccccaggcagatgttatcgaggtccgacnnnnnnaaaaacatcccaaaaacaa

SEQ ID NO: 1654 - DNA, 118 bp, Artificial Sequence
  Description of Artificial Sequence: Synthetic polynucleotide
  modified_base (89)..(94): a, c, t, g, unknown or other
acaaactctatccctttaaatagttggaggctcatcgttcctattcccccccccccccccccccaggcagatgttatcgaggtccgacnnnnnnacaaacacacacacaaaaccacaa

SEQ ID NO: 1655 - DNA, 118 bp, Artificial Sequence
  Description of Artificial Sequence: Synthetic polynucleotide
  modified_base (88)..(93): a, c, t, g, unknown or other
acccataaactatacataataaaacttccgttggaggctcatcgttcctattcccccccccccaggcagatgttatcgaggtccgacnnnnnnaataaatactaacttcataaaattt

SEQ ID NO: 1656 - DNA, 118 bp, Artificial Sequence
  Description of Artificial Sequence: Synthetic polynucleotide
  modified_base (87)..(92): a, c, t, g, unknown or other
atactcctctctcctttcctcaattgttggaggctcatcgttcctattccccccccccccccaggcagatgttatcgaggtccgacnnnnnntaaatactaaaacttaaaataacaaa

SEQ ID NO: 1657 - DNA, 118 bp, Artificial Sequence
  Description of Artificial Sequence: Synthetic polynucleotide
  modified_base (86)..(91): a, c, t, g, unknown or other
acacatttaacctaatcaaccttttccgttggaggctcatcgttcctattcccccccccccaggcagatgttatcgaggtccgacnnnnnnttaaaatttaattaaaatcacaaattt

SEQ ID NO: 1658 - DNA, 118 bp, Artificial Sequence
  Description of Artificial Sequence: Synthetic polynucleotide
  modified_base (84)..(89): a, c, t, g, unknown or other
acatcaacaaaaattcacaccccagttggaggctcatcgttcctattccccccccccccaggcagatgttatcgaggtccgacnnnnnnttacttaattaaaattaatttcttataat

SEQ ID NO: 1659 - DNA, 118 bp, Artificial Sequence
  Description of Artificial Sequence: Synthetic polynucleotide
  modified_base (94)..(99): a, c, t, g, unknown or other
actcttaactttacaccttctaaccatgttggaggctcatcgttcctattcccccccccccccccccccaggcagatgttatcgaggtccgacnnnnnnaaaatttcctccacccatt

SEQ ID NO: 1660 - DNA, 118 bp, Artificial Sequence
  Description of Artificial Sequence: Synthetic polynucleotide
  modified_base (86)..(91): a, c, t, g, unknown or other
acccctattaaatatcaatttctccatagttggaggctcatcgttcctattccccccccccaggcagatgttatcgaggtccgacnnnnnnaaaaataaaattttatctctttatttt

SEQ ID NO: 1661 - DNA, 118 bp, Artificial Sequence
  Description of Artificial Sequence: Synthetic polynucleotide
  modified_base (91)..(96): a, c, t, g, unknown or other
aaatcactaatacccaaaactctctaccgttggaggctcatcgttcctattcccccccccccccccaggcagatgttatcgaggtccgacnnnnnnaaataaaaacccaattacctat

SEQ ID NO: 1662 - DNA, 118 bp, Artificial Sequence
  Description of Artificial Sequence: Synthetic polynucleotide
  modified_base (88)..(93): a, c, t, g, unknown or other
acattcttccctaccaacccatcctatcccgttggaggctcatcgttcctattccccccccccaggcagatgttatcgaggtccgacnnnnnnataaattcttcttcccctcccatca

SEQ ID NO: 1663 - DNA, 118 bp, Artificial Sequence
  Description of Artificial Sequence: Synthetic polynucleotide
  modified_base (84)..(89): a, c, t, g, unknown or other
ccctataaataaataaacataattcccgttggaggctcatcgttcctattcccccccccaggcagatgttatcgaggtccgacnnnnnntttaaatccctattaaaactccttcataa

SEQ ID NO: 1664 - DNA, 118 bp, Artificial Sequence
  Description of Artificial Sequence: Synthetic polynucleotide
  modified_base (91)..(96): a, c, t, g, unknown or other
atctcaaattcctaaactcaaataatctgttggaggctcatcgttcctattcccccccccccccccaggcagatgttatcgaggtccgacnnnnnnaacctccaaataactaaaatta

SEQ ID NO: 1665 - DNA, 118 bp, Artificial Sequence
  Description of Artificial Sequence: Synthetic polynucleotide
  modified_base (91)..(96): a, c, t, g, unknown or other
atccctaaactccttctcaaaatagttggaggctcatcgttcctattcccccccccccccccccccaggcagatgttatcgaggtccgacnnnnnnaaatcccaaatcaaaataaaaa

SEQ ID NO: 1666 - DNA, 118 bp, Artificial Sequence
  Description of Artificial Sequence: Synthetic polynucleotide
  modified_base (86)..(91): a, c, t, g, unknown or other
accctctatactaaaacaatctactgttggaggctcatcgttcctattcccccccccccccaggcagatgttatcgaggtccgacnnnnnnttttaacataaataatcctaaaaacta

SEQ ID NO: 1667 - DNA, 118 bp, Artificial Sequence
  Description of Artificial Sequence: Synthetic polynucleotide
  modified_base (84)..(89): a, c, t, g, unknown or other
acctctatataaaaattccccgttggaggctcatcgttcctattcccccccccccccccaggcagatgttatcgaggtccgacnnnnnntcaacttacttcactctcaaaccttctct

SEQ ID NO: 1668 - DNA, 118 bp, Artificial Sequence
  Description of Artificial Sequence: Synthetic polynucleotide
  modified_base (92)..(97): a, c, t, g, unknown or other
atcccatcaacataacaaaataataaacagttggaggctcatcgttcctattcccccccccccccccaggcagatgttatcgaggtccgacnnnnnnatccccaacaaaatctaaaat

SEQ ID NO: 1669 - DNA, 118 bp, Artificial Sequence
  Description of Artificial Sequence: Synthetic polynucleotide
  modified_base (89)..(94): a, c, t, g, unknown or other
tccccaactcctcccataaaaaccacgttggaggctcatcgttcctattcccccccccccccccaggcagatgttatcgaggtccgacnnnnnnaatatttcccccaaaacactcaat

SEQ ID NO: 1670 - DNA, 118 bp, Artificial Sequence
  Description of Artificial Sequence: Synthetic polynucleotide
  modified_base (84)..(89): a, c, t, g, unknown or other
acaccaaaaatcatataatatcaaagttggaggctcatcgttcctattcccccccccccaggcagatgttatcgaggtccgacnnnnnnaacactcccatccaaaacctctttctcat

SEQ ID NO: 1671 - DNA, 118 bp, Artificial Sequence
  Description of Artificial Sequence: Synthetic polynucleotide
  modified_base (86)..(91): a, c, t, g, unknown or other
accctctcctctaacaacctacgttggaggctcatcgttcctattccccccccccccccccaggcagatgttatcgaggtccgacnnnnnntaaaaaccctatctaaaacaaaactat

SEQ ID NO: 1672 - DNA, 118 bp, Artificial Sequence
  Description of Artificial Sequence: Synthetic polynucleotide
  modified_base (92)..(97): a, c, t, g, unknown or other
actccaatatcccctcttaaccaccaaatagttggaggctcatcgttcctattccccccccccccccaggcagatgttatcgaggtccgacnnnnnnataaaattataaccctaccca

SEQ ID NO: 1673 - DNA, 118 bp, Artificial Sequence
  Description of Artificial Sequence: Synthetic polynucleotide
  modified_base (92)..(97): a, c, t, g, unknown or other
aaacacatttcttttacaactaattactcgttggaggctcatcgttcctattcccccccccccccccaggcagatgttatcgaggtccgacnnnnnnttacattcaaaaatccaaccc

SEQ ID NO: 1674 - DNA, 118 bp, Artificial Sequence
  Description of Artificial Sequence: Synthetic polynucleotide
  modified_base (86)..(91): a, c, t, g, unknown or other
atttcacaatactcaccaaaataaccagttggaggctcatcgttcctattcccccccccccaggcagatgttatcgaggtccgacnnnnnnaattcaaaatttaactcttatactttt

SEQ ID NO: 1675 - DNA, 118 bp, Artificial Sequence
  Description of Artificial Sequence: Synthetic polynucleotide
  modified_base (83)..(88): a, c, t, g, unknown or other
acatcatattactataaacatttatatacgttggaggctcatcgttcctattccccccaggcagatgttatcgaggtccgacnnnnnnttcatttcttttcattacccaaaaatatta

SEQ ID NO: 1676 - DNA, 118 bp, Artificial Sequence
  Description of Artificial Sequence: Synthetic polynucleotide
  modified_base (94)..(99): a, c, t, g, unknown or other
acccaaaactacacaatattttattgttggaggctcatcgttcctattcccccccccccccccccccccaggcagatgttatcgaggtccgacnnnnnnaaaaacacaacctcaaaaa

SEQ ID NO: 1677 - DNA, 118 bp, Artificial Sequence
  Description of Artificial Sequence: Synthetic polynucleotide
  modified_base (84)..(89): a, c, t, g, unknown or other
ccccaaaacaacttataaatacatcctaagttggaggctcatcgttcctattcccccccaggcagatgttatcgaggtccgacnnnnnntttttatttttaataaaaatttttaaaac

SEQ ID NO: 1678 - DNA, 118 bp, Artificial Sequence
  Description of Artificial Sequence: Synthetic polynucleotide
  modified_base (90)..(95): a, c, t, g, unknown or other
acttaaataatccaccctttatttaacatgttggaggctcatcgttcctattcccccccccccccaggcagatgttatcgaggtccgacnnnnnntaattatcttcactactacactc

SEQ ID NO: 1679 - DNA, 118 bp, Artificial Sequence
  Description of Artificial Sequence: Synthetic polynucleotide
  modified_base (95)..(100): a, c, t, g, unknown or other
aaacctactttatctcccgttggaggctcatcgttcctattcccccccccccccccccccccccccccccaggcagatgttatcgaggtccgacnnnnnntccatcaaccctaccaaa

SEQ ID NO: 1680 - DNA, 118 bp, Artificial Sequence
  Description of Artificial Sequence: Synthetic polynucleotide
  modified_base (90)..(95): a, c, t, g, unknown or other
ctactactaaaaactacccaaactatctacaagttggaggctcatcgttcctattccccccccccaggcagatgttatcgaggtccgacnnnnnnaaaacctttctatccaatcctaa

SEQ ID NO: 1681 - DNA, 118 bp, Artificial Sequence
  Description of Artificial Sequence: Synthetic polynucleotide
  modified_base (85)..(90): a, c, t, g, unknown or other
atataacccacaaaacctaaatatttgttggaggctcatcgttcctattcccccccccccaggcagatgttatcgaggtccgacnnnnnntatttatataaacttttacaaaacataa

SEQ ID NO: 1682 - DNA, 118 bp, Artificial Sequence
  Description of Artificial Sequence: Synthetic polynucleotide
  modified_base (84)..(89): a, c, t, g, unknown or other
attccctctaataaaaccccgttggaggctcatcgttcctattccccccccccccccccaggcagatgttatcgaggtccgacnnnnnnaaatcctttcttcctccttaaaataaata

SEQ ID NO: 1683 - DNA, 118 bp, Artificial Sequence
  Description of Artificial Sequence: Synthetic polynucleotide
  modified_base (89)..(94): a, c, t, g, unknown or other
acccaacaaatttaaccaatcgttggaggctcatcgttcctattccccccccccccccccccccaggcagatgttatcgaggtccgacnnnnnnttactaactcctcctatcaaccaa

SEQ ID NO: 1684 - DNA, 118 bp, Artificial Sequence
  Description of Artificial Sequence: Synthetic polynucleotide
  modified_base (82)..(87): a, c, t, g, unknown or other
actctctactctcccacccagttggaggctcatcgttcctattccccccccccccccaggcagatgttatcgaggtccgacnnnnnnaaatctcttttaaacaacacatttcaatttt

SEQ ID NO: 1685 - DNA, 118 bp, Artificial Sequence
  Description of Artificial Sequence: Synthetic polynucleotide
  modified_base (88)..(93): a, c, t, g, unknown or other
acacttactttctccctaactaccagttggaggctcatcgttcctattcccccccccccccccaggcagatgttatcgaggtccgacnnnnnnaaaaacattaaaactaaaattatac

SEQ ID NO: 1686 - DNA, 118 bp, Artificial Sequence
  Description of Artificial Sequence: Synthetic polynucleotide
  modified_base (81)..(86): a, c, t, g, unknown or other
accacaacccccaaaattcaagttggaggctcatcgttcctattccccccccccccaggcagatgttatcgaggtccgacnnnnnnaaactaaaaattaactaactctaatttaacat

SEQ ID NO: 1687 - DNA, 118 bp, Artificial Sequence
  Description of Artificial Sequence: Synthetic polynucleotide
  modified_base (93)..(98): a, c, t, g, unknown or other
ataataaaacactaaaactaattaaaaacgttggaggctcatcgttcctattccccccccccccccccaggcagatgttatcgaggtccgacnnnnnnaaacaactcactacaattaa

SEQ ID NO: 1688 - DNA, 118 bp, Artificial Sequence
  Description of Artificial Sequence: Synthetic polynucleotide
  modified_base (88)..(93): a, c, t, g, unknown or other
cttttataaaaacttctaaatattttatttatgttggaggctcatcgttcctattccccccccaggcagatgttatcgaggtccgacnnnnnncaaccttataaataaattttattca

SEQ ID NO: 1689 - DNA, 118 bp, Artificial Sequence
  Description of Artificial Sequence: Synthetic polynucleotide
  modified_base (87)..(92): a, c, t, g, unknown or other
ctcttaattaaacctaataaaaataaaaacagttggaggctcatcgttcctattccccccccaggcagatgttatcgaggtccgacnnnnnntctctaacttttaaaaatattaaaaa

SEQ ID NO: 1690 - DNA, 118 bp, Artificial Sequence
  Description of Artificial Sequence: Synthetic polynucleotide
  modified_base (85)..(90): a, c, t, g, unknown or other
aaacaaaaatcttaaaccaaaatcgttggaggctcatcgttcctattcccccccccccccaggcagatgttatcgaggtccgacnnnnnnaaaactcaaattatttcatccactaaaa

SEQ ID NO: 1691 - DNA, 118 bp, Artificial Sequence
  Description of Artificial Sequence: Synthetic polynucleotide
  modified_base (87)..(92): a, c, t, g, unknown or other
ataaaatataaactaaacacaataacttacgttggaggctcatcgttcctattcccccccccaggcagatgttatcgaggtccgacnnnnnntttaacctacaaaaacattacaattt

SEQ ID NO: 1692 - DNA, 118 bp, Artificial Sequence
  Description of Artificial Sequence: Synthetic polynucleotide
  modified_base (89)..(94): a, c, t, g, unknown or other
atcacaaacaacaaaaactaaaaagttggaggctcatcgttcctattcccccccccccccccccaggcagatgttatcgaggtccgacnnnnnnttcctctactaaatacaccaaaaa

SEQ ID NO: 1693 - DNA, 118 bp, Artificial Sequence
  Description of Artificial Sequence: Synthetic polynucleotide
  modified_base (88)..(93): a, c, t, g, unknown or other
acttaaactataccaattacctactaaagttggaggctcatcgttcctattccccccccccccaggcagatgttatcgaggtccgacnnnnnnactaaatctttaaattctccaacca

SEQ ID NO: 1694 - DNA, 118 bp, Artificial Sequence
  Description of Artificial Sequence: Synthetic polynucleotide
  modified_base (96)..(101): a, c, t, g, unknown or other
accaaattcaaacccaaatacaaaataaaagttggaggctcatcgttcctattccccccccccccccccccaggcagatgttatcgaggtccgacnnnnnntcaaaaccctaaaaccc

SEQ ID NO: 1695 - DNA, 118 bp, Artificial Sequence
  Description of Artificial Sequence: Synthetic polynucleotide
  modified_base (92)..(97): a, c, t, g, unknown or other
accacactaacatctcaacaacgttggaggctcatcgttcctattccccccccccccccccccccccaggcagatgttatcgaggtccgacnnnnnnacatcccaacaattaaactaa

SEQ ID NO: 1696 - DNA, 118 bp, Artificial Sequence
  Description of Artificial Sequence: Synthetic polynucleotide
  modified_base (87)..(92): a, c, t, g, unknown or other
accaaaactaaaacaccttacaaaaagttggaggctcatcgttcctattcccccccccccccaggcagatgttatcgaggtccgacnnnnnnacaatattactcttaaaaataactaa

SEQ ID NO: 1697 - DNA, 118 bp, Artificial Sequence
  Description of Artificial Sequence: Synthetic polynucleotide
  modified_base (86)..(91): a, c, t, g, unknown or other
ctccaatctaaaatctatacaacttcacgttggaggctcatcgttcctattccccccccccaggcagatgttatcgaggtccgacnnnnnntaaaatctacaatatatctttcctaaa

SEQ ID NO: 1698 - DNA, 118 bp, Artificial Sequence
  Description of Artificial Sequence: Synthetic polynucleotide
  modified_base (85)..(90): a, c, t, g, unknown or other
acttatctaaacctaaacccatcatgttggaggctcatcgttcctattccccccccccccaggcagatgttatcgaggtccgacnnnnnnttttacccaactataaactaatataata

SEQ ID NO: 1699 - DNA, 118 bp, Artificial Sequence
  Description of Artificial Sequence: Synthetic polynucleotide
  modified_base (85)..(90): a, c, t, g, unknown or other
atcccccactaaacctacaacttaagttggaggctcatcgttcctattccccccccccccaggcagatgttatcgaggtccgacnnnnnnaaaaataaatatcttattaataacaaat

SEQ ID NO: 1700 - DNA, 118 bp, Artificial Sequence
  Description of Artificial Sequence: Synthetic polynucleotide
  modified_base (84)..(89): a, c, t, g, unknown or other
acaaatacaaacacttcccacccaaaagttggaggctcatcgttcctattcccccccccaggcagatgttatcgaggtccgacnnnnnnttattatctaaatttttatctaaatacca

SEQ ID NO: 1701 - DNA, 118 bp, Artificial Sequence
  Description of Artificial Sequence: Synthetic polynucleotide
  modified_base (95)..(100): a, c, t, g, unknown or other
acaaaatcctcaaatcaataataactcgttggaggctcatcgttcctattccccccccccccccccccccaggcagatgttatcgaggtccgacnnnnnntaactaaccaacttcctc

SEQ ID NO: 1702 - DNA, 118 bp, Artificial Sequence
  Description of Artificial Sequence: Synthetic polynucleotide
  modified_base (89)..(94): a, c, t, g, unknown or other
actcaaactataaaacccaaataaccaagttggaggctcatcgttcctattcccccccccccccaggcagatgttatcgaggtccgacnnnnnnataaaaataacaaatttaaaacca

SEQ ID NO: 1703 - DNA, 118 bp, Artificial Sequence
  Description of Artificial Sequence: Synthetic polynucleotide
  modified_base (90)..(95): a, c, t, g, unknown or other
atctatttccacttcaaccccgttggaggctcatcgttcctattcccccccccccccccccccccaggcagatgttatcgaggtccgacnnnnnnacaaccaacaacctcaacaaaaa

SEQ ID NO: 1704 - DNA, 118 bp, Artificial Sequence
  Description of Artificial Sequence: Synthetic polynucleotide
  modified_base (88)..(93): a, c, t, g, unknown or other
actcatacctataatcccaacactttaagttggaggctcatcgttcctattccccccccccccaggcagatgttatcgaggtccgacnnnnnntaatccaaatatattccaactaatt

SEQ ID NO: 1705 - DNA, 118 bp, Artificial Sequence
  Description of Artificial Sequence: Synthetic polynucleotide
  modified_base (87)..(92): a, c, t, g, unknown or other
aaaaataaaaacatctactaacacgttggaggctcatcgttcctattcccccccccccccccaggcagatgttatcgaggtccgacnnnnnnaaaaattctatcaacaaccaattaaa

SEQ ID NO: 1706 - DNA, 118 bp, Artificial Sequence
  Description of Artificial Sequence: Synthetic polynucleotide
  modified_base (90)..(95): a, c, t, g, unknown or other
actctacctttctaacaaaccgttggaggctcatcgttcctattcccccccccccccccccccccaggcagatgttatcgaggtccgacnnnnnntaaaacctcactaactactacac

SEQ ID NO: 1707 - DNA, 118 bp, Artificial Sequence
  Description of Artificial Sequence: Synthetic polynucleotide
  modified_base (85)..(90): a, c, t, g, unknown or other
ccctaaacacctaacacaaatcctgttggaggctcatcgttcctattcccccccccccccaggcagatgttatcgaggtccgacnnnnnnatattatcattcaccattttaattaaat

SEQ ID NO: 1708 - DNA, 118 bp, Artificial Sequence
  Description of Artificial Sequence: Synthetic polynucleotide
  modified_base (86)..(91): a, c, t, g, unknown or other
actttcaatactccataaaatccccgttggaggctcatcgttcctattcccccccccccccaggcagatgttatcgaggtccgacnnnnnnaatatctttcaaaaattatctataatt

SEQ ID NO: 1709 - DNA, 118 bp, Artificial Sequence
  Description of Artificial Sequence: Synthetic polynucleotide
  modified_base (82)..(87): a, c, t, g, unknown or other
atcaaactctctccactacctacgttggaggctcatcgttcctattcccccccccccaggcagatgttatcgaggtccgacnnnnnnttctttctataatttaatttctataaaaaca

SEQ ID NO: 1710 - DNA, 118 bp, Artificial Sequence
  Description of Artificial Sequence: Synthetic polynucleotide
  modified_base (88)..(93): a, c, t, g, unknown or other
ctactcaaataacctaaacctccgttggaggctcatcgttcctattcccccccccccccccccaggcagatgttatcgaggtccgacnnnnnntctatcaaactaccctaaataaaaa

SEQ ID NO: 1711 - DNA, 118 bp, Artificial Sequence
  Description of Artificial Sequence: Synthetic polynucleotide
  modified_base (88)..(93): a, c, t, g, unknown or other
ttccacaaaaacccaactcttaattctatagttggaggctcatcgttcctattccccccccccaggcagatgttatcgaggtccgacnnnnnntccccatcacaccccaccccatata

SEQ ID NO: 1712 - DNA, 118 bp, Artificial Sequence
  Description of Artificial Sequence: Synthetic polynucleotide
  modified_base (96)..(101): a, c, t, g, unknown or other
atctatacctatcactacataaaatcgttggaggctcatcgttcctattccccccccccccccccccccccaggcagatgttatcgaggtccgacnnnnnnctaacttcaccaacctc

SEQ ID NO: 1713 - DNA, 118 bp, Artificial Sequence
  Description of Artificial Sequence: Synthetic polynucleotide
  modified_base (85)..(90): a, c, t, g, unknown or other
ctctaacatctcttaaatatcccaacttgttggaggctcatcgttcctattcccccccccaggcagatgttatcgaggtccgacnnnnnnttaatacacaaatataaataaattactt

SEQ ID NO: 1714 - DNA, 118 bp, Artificial Sequence
  Description of Artificial Sequence: Synthetic polynucleotide
  modified_base (82)..(87): a, c, t, g, unknown or other
aacaactttaaatccaccgttggaggctcatcgttcctattccccccccccccccccaggcagatgttatcgaggtccgacnnnnnnctttataatacaaataactttcccactaacc

SEQ ID NO: 1715 - DNA, 118 bp, Artificial Sequence
  Description of Artificial Sequence: Synthetic polynucleotide
  modified_base (85)..(90): a, c, t, g, unknown or other
acaaaaataaaattcaaaaccatttttgttggaggctcatcgttcctattccccccccccaggcagatgttatcgaggtccgacnnnnnnaaaaattataattttaaaaatactttcc

SEQ ID NO: 1716 - DNA, 118 bp, Artificial Sequence
  Description of Artificial Sequence: Synthetic polynucleotide
  modified_base (83)..(88): a, c, t, g, unknown or other
atttctcccatatcaaaactcaagttggaggctcatcgttcctattccccccccccccaggcagatgttatcgaggtccgacnnnnnnaataacaaaaactatcctatttcctaaata

SEQ ID NO: 1717 - DNA, 118 bp, Artificial Sequence
  Description of Artificial Sequence: Synthetic polynucleotide
  modified_base (91)..(96): a, c, t, g, unknown or other
acaaacacaacatcttccacccacgttggaggctcatcgttcctattcccccccccccccccccccaggcagatgttatcgaggtccgacnnnnnnaaaaattacaaactcccaaata

SEQ ID NO: 1718 - DNA, 118 bp, Artificial Sequence
  Description of Artificial Sequence: Synthetic polynucleotide
  modified_base (82)..(87): a, c, t, g, unknown or other
atacaaatctttataaccacatgttggaggctcatcgttcctattccccccccccccaggcagatgttatcgaggtccgacnnnnnnttataaacctaaaactatactatctaataca

SEQ ID NO: 1719 - DNA, 118 bp, Artificial Sequence
  Description of Artificial Sequence: Synthetic polynucleotide
  modified_base (87)..(92): a, c, t, g, unknown or other
acacaacaaactccattctttcataaagttggaggctcatcgttcctattccccccccccccaggcagatgttatcgaggtccgacnnnnnnttaatcattccctaaataaattttaa

SEQ ID NO: 1720 - DNA, 118 bp, Artificial Sequence
  Description of Artificial Sequence: Synthetic polynucleotide
  modified_base (91)..(96): a, c, t, g, unknown or other
caataacaaaattaataaaaatattcaaatctgttggaggctcatcgttcctattcccccccccccaggcagatgttatcgaggtccgacnnnnnntctccctataatactatacttc

SEQ ID NO: 1721 - DNA, 118 bp, Artificial Sequence
  Description of Artificial Sequence: Synthetic polynucleotide
  modified_base (91)..(96): a, c, t, g, unknown or other
acccaaaaactataattttaatttctttgttggaggctcatcgttcctattcccccccccccccccaggcagatgttatcgaggtccgacnnnnnnacaaaataaaactaaatctcca

SEQ ID NO: 1722 - DNA, 118 bp, Artificial Sequence
  Description of Artificial Sequence: Synthetic polynucleotide
  modified_base (92)..(97): a, c, t, g, unknown or other
cctaaatctccaaatactaataaaactccgttggaggctcatcgttcctattcccccccccccccccaggcagatgttatcgaggtccgacnnnnnnaaatatctacacctctaaccc

SEQ ID NO: 1723 - DNA, 118 bp, Artificial Sequence
  Description of Artificial Sequence: Synthetic polynucleotide
  modified_base (91)..(96): a, c, t, g, unknown or other
acaaaaccctaaactcccgttggaggctcatcgttcctattcccccccccccccccccccccccccaggcagatgttatcgaggtccgacnnnnnnaactcaccttcacaaaactatc

SEQ ID NO: 1724 - DNA, 118 bp, Artificial Sequence
  Description of Artificial Sequence: Synthetic polynucleotide
  modified_base (90)..(95): a, c, t, g, unknown or other
attaaccaaatataataattcatacccgttggaggctcatcgttcctattcccccccccccccccaggcagatgttatcgaggtccgacnnnnnnttcctcttctaattttaaaaact

SEQ ID NO: 1725 - DNA, 118 bp, Artificial Sequence
  Description of Artificial Sequence: Synthetic polynucleotide
  modified_base (88)..(93): a, c, t, g, unknown or other
actctataacctaactatacctttactaagttggaggctcatcgttcctattcccccccccccaggcagatgttatcgaggtccgacnnnnnnattttccaaaataaccaaacacttt

SEQ ID NO: 1726 - DNA, 118 bp, Artificial Sequence
  Description of Artificial Sequence: Synthetic polynucleotide
  modified_base (89)..(94): a, c, t, g, unknown or other
acccctaacaactacctcaactaaaaagttggaggctcatcgttcctattccccccccccccccaggcagatgttatcgaggtccgacnnnnnnaaaaatccaactcctcctactaat

SEQ ID NO: 1727 - DNA, 118 bp, Artificial Sequence
  Description of Artificial Sequence: Synthetic polynucleotide
  modified_base (84)..(89): a, c, t, g, unknown or other
atctcccaacctcaatacctagttggaggctcatcgttcctattcccccccccccccccaggcagatgttatcgaggtccgacnnnnnnctactcctcaaaacttaataaataaaaac

SEQ ID NO: 1728 - DNA, 118 bp, Artificial Sequence
  Description of Artificial Sequence: Synthetic polynucleotide
  modified_base (97)..(102): a, c, t, g, unknown or other
cccactcaaaaccattcaaacgttggaggctcatcgttcctattccccccccccccccccccccccccccccaggcagatgttatcgaggtccgacnnnnnncctcaacccaacctcc

SEQ ID NO: 1729 - DNA, 118 bp, Artificial Sequence
  Description of Artificial Sequence: Synthetic polynucleotide
  modified_base (88)..(93): a, c, t, g, unknown or other
ataatcaacctaaaccccgttggaggctcatcgttcctattccccccccccccccccccccccaggcagatgttatcgaggtccgacnnnnnnaacccaaaaactaaaaacaaactaa

SEQ ID NO: 1730 - DNA, 118 bp, Artificial Sequence
  Description of Artificial Sequence: Synthetic polynucleotide
  modified_base (82)..(87): a, c, t, g, unknown or other
ccctacaaaatttcatcaatgttggaggctcatcgttcctattccccccccccccccaggcagatgttatcgaggtccgacnnnnnntaaacaacttacctccctactctaactactt

SEQ ID NO: 1731 - DNA, 118 bp, Artificial Sequence
  Description of Artificial Sequence: Synthetic polynucleotide
  modified_base (94)..(99): a, c, t, g, unknown or other
ctactttttcttcactttttattaatatatagttggaggctcatcgttcctattcccccccccccccccaggcagatgttatcgaggtccgacnnnnnnacctcccaaaatactaaaa

SEQ ID NO: 1732 - DNA, 118 bp, Artificial Sequence
  Description of Artificial Sequence: Synthetic polynucleotide
  modified_base (85)..(90): a, c, t, g, unknown or other
acacaaaaccaatatattttcatcaaagttggaggctcatcgttcctattccccccccccaggcagatgttatcgaggtccgacnnnnnnttataaaacacccaactatttttaaatt

SEQ ID NO: 1733 - DNA, 118 bp, Artificial Sequence
  Description of Artificial Sequence: Synthetic polynucleotide
  modified_base (93)..(98): a, c, t, g, unknown or other
attccttatttaataaaattaacttaacgttggaggctcatcgttcctattcccccccccccccccccaggcagatgttatcgaggtccgacnnnnnnatcctaaaaactaaccaaaa

SEQ ID NO: 1734 - DNA, 118 bp, Artificial Sequence
  Description of Artificial Sequence: Synthetic polynucleotide
  modified_base (91)..(96): a, c, t, g, unknown or other
ataaaaccttattatattacccaaactgttggaggctcatcgttcctattccccccccccccccccaggcagatgttatcgaggtccgacnnnnnnttaaacaatccttttaccttaa

SEQ ID NO: 1735 - DNA, 118 bp, Artificial Sequence
  Description of Artificial Sequence: Synthetic polynucleotide
  modified_base (96)..(101): a, c, t, g, unknown or other
acactaaactatccttatctaatataaaaatagttggaggctcatcgttcctattccccccccccccccccaggcagatgttatcgaggtccgacnnnnnnaaaaacaacaaccccaa

SEQ ID NO: 1736 - DNA, 118 bp, Artificial Sequence
  Description of Artificial Sequence: Synthetic polynucleotide
  modified_base (85)..(90): a, c, t, g, unknown or other
acatatccttccataactctcaaagttggaggctcatcgttcctattcccccccccccccaggcagatgttatcgaggtccgacnnnnnntatttttaaaatataaaactaaaatcca

SEQ ID NO: 1737 - DNA, 118 bp, Artificial Sequence
  Description of Artificial Sequence: Synthetic polynucleotide
  modified_base (88)..(93): a, c, t, g, unknown or other
acccctacaactccatcgttggaggctcatcgttcctattcccccccccccccccccccccccaggcagatgttatcgaggtccgacnnnnnnaaaactttaaaactttatcttacat

SEQ ID NO: 1738 - DNA, 118 bp, Artificial Sequence
  Description of Artificial Sequence: Synthetic polynucleotide
  modified_base (81)..(86): a, c, t, g, unknown or other
acctcctatctacttccgttggaggctcatcgttcctattccccccccccccccccaggcagatgttatcgaggtccgacnnnnnnaacctaacccttctcaacaacatacaataaaa

SEQ ID NO: 1739 - DNA, 118 bp, Artificial Sequence
  Description of Artificial Sequence: Synthetic polynucleotide
  modified_base (83)..(88): a, c, t, g, unknown or other
cttccctcccatccccctacccagttggaggctcatcgttcctattccccccccccccaggcagatgttatcgaggtccgacnnnnnnttcttcattttaaaaatccataatattaat

SEQ ID NO: 1740 - DNA, 118 bp, Artificial Sequence
  Description of Artificial Sequence: Synthetic polynucleotide
  modified_base (85)..(90): a, c, t, g, unknown or other
atcccaaccaccttaaatccccaagttggaggctcatcgttcctattcccccccccccccaggcagatgttatcgaggtccgacnnnnnntaataaaaacacttactacattatatta

SEQ ID NO: 1741 - DNA, 118 bp, Artificial Sequence
  Description of Artificial Sequence: Synthetic polynucleotide
  modified_base (93)..(98): a, c, t, g, unknown or other
atatactttattttacacttctacacatacaagttggaggctcatcgttcctattcccccccccccccaggcagatgttatcgaggtccgacnnnnnnaaaaattccttctaccaaaa

SEQ ID NO: 1742 - DNA, 118 bp, Artificial Sequence
  Description of Artificial Sequence: Synthetic polynucleotide
  modified_base (90)..(95): a, c, t, g, unknown or other
actcacccaactcaaacttcctctatgttggaggctcatcgttcctattccccccccccccccccaggcagatgttatcgaggtccgacnnnnnnataaaaccatataaatactccca

SEQ ID NO: 1743 - DNA, 118 bp, Artificial Sequence
  Description of Artificial Sequence: Synthetic polynucleotide
  modified_base (92)..(97): a, c, t, g, unknown or other
attctcaactctactctaacctgttggaggctcatcgttcctattccccccccccccccccccccccaggcagatgttatcgaggtccgacnnnnnnattcaccacaaaaattaaaaa

SEQ ID NO: 1744 - DNA, 118 bp, Artificial Sequence
  Description of Artificial Sequence: Synthetic polynucleotide
  modified_base (82)..(87): a, c, t, g, unknown or other
attcttccccttcttttaacatttgttggaggctcatcgttcctattccccccccccaggcagatgttatcgaggtccgacnnnnnntaattaaattacacaaaataacaaaattaaa

SEQ ID NO: 1745 - DNA, 118 bp, Artificial Sequence
  Description of Artificial Sequence: Synthetic polynucleotide
  modified_base (88)..(93): a, c, t, g, unknown or other
atttaaaaaccaaatacctccaaatactagttggaggctcatcgttcctattcccccccccccaggcagatgttatcgaggtccgacnnnnnntaaaataacttattcttaaaaacca

SEQ ID NO: 1746 - DNA, 118 bp, Artificial Sequence
  Description of Artificial Sequence: Synthetic polynucleotide
  modified_base (92)..(97): a, c, t, g, unknown or other
atccacaactactaccaaaactagttggaggctcatcgttcctattcccccccccccccccccccccaggcagatgttatcgaggtccgacnnnnnnaaactctcaaacactcaaaaa

SEQ ID NO: 1747 - DNA, 118 bp, Artificial Sequence
  Description of Artificial Sequence: Synthetic polynucleotide
  modified_base (90)..(95): a, c, t, g, unknown or other
atttaacttttcatcaataacctagttggaggctcatcgttcctattccccccccccccccccccaggcagatgttatcgaggtccgacnnnnnnaaactactctctaattcaaataa

SEQ ID NO: 1748 - DNA, 118 bp, Artificial Sequence
  Description of Artificial Sequence: Synthetic polynucleotide
  modified_base (87)..(92): a, c, t, g, unknown or other
acctccccaccccaacccatagttggaggctcatcgttcctattccccccccccccccccccaggcagatgttatcgaggtccgacnnnnnnttttactataaacaacaatattataa

SEQ ID NO: 1749 - DNA, 118 bp, Artificial Sequence
  Description of Artificial Sequence: Synthetic polynucleotide
  modified_base (91)..(96): a, c, t, g, unknown or other
acctcccaacaacctctttaaactgttggaggctcatcgttcctattcccccccccccccccccccaggcagatgttatcgaggtccgacnnnnnntctccaaacccacttacaacct

SEQ ID NO: 1750 - DNA, 118 bp, Artificial Sequence
  Description of Artificial Sequence: Synthetic polynucleotide
  modified_base (85)..(90): a, c, t, g, unknown or other
ctaccctccttccccacccgttggaggctcatcgttcctattccccccccccccccccccaggcagatgttatcgaggtccgacnnnnnnaccctaccactacaactaccataaatat

SEQ ID NO: 1751 - DNA, 118 bp, Artificial Sequence
  Description of Artificial Sequence: Synthetic polynucleotide
  modified_base (85)..(90): a, c, t, g, unknown or other
actcctcacttctcaaacgttggaggctcatcgttcctattcccccccccccccccccccaggcagatgttatcgaggtccgacnnnnnnaaaactaacccccacctccctccaaaac

SEQ ID NO: 1752 - DNA, 118 bp, Artificial Sequence
  Description of Artificial Sequence: Synthetic polynucleotide
  modified_base (87)..(92): a, c, t, g, unknown or other
aaactccccacttttccccgttggaggctcatcgttcctattccccccccccccccccccccaggcagatgttatcgaggtccgacnnnnnnccccacccccaaacaaatcaccaaaa

SEQ ID NO: 1753 - DNA, 118 bp, Artificial Sequence
  Description of Artificial Sequence: Synthetic polynucleotide
  modified_base (93)..(98): a, c, t, g, unknown or other
ctatcacttcctctcttccgttggaggctcatcgttcctattccccccccccccccccccccccccccaggcagatgttatcgaggtccgacnnnnnnaaaacaaccataacccaaac

SEQ ID NO: 1754 - DNA, 118 bp, Artificial Sequence
  Description of Artificial Sequence: Synthetic polynucleotide
  modified_base (93)..(98): a, c, t, g, unknown or other
aaaatataacctaaaaacaaaataattaacgttggaggctcatcgttcctattcccccccccccccccaggcagatgttatcgaggtccgacnnnnnntttatcaaaatcaactccaa

SEQ ID NO: 1755 - DNA, 118 bp, Artificial Sequence
  Description of Artificial Sequence: Synthetic polynucleotide
  modified_base (92)..(97): a, c, t, g, unknown or other
attttattcccactcccctctctaaaagttggaggctcatcgttcctattcccccccccccccccccaggcagatgttatcgaggtccgacnnnnnnactaaaaccaacccacctttt

SEQ ID NO: 1756 - DNA, 118 bp, Artificial Sequence
  Description of Artificial Sequence: Synthetic polynucleotide
  modified_base (87)..(92): a, c, t, g, unknown or other
ctataacaaaaccaacaacttctctaaacgttggaggctcatcgttcctattccccccccccaggcagatgttatcgaggtccgacnnnnnntcaaaataatttaaaaatatctcatt

SEQ ID NO: 1757 - DNA, 118 bp, Artificial Sequence
  Description of Artificial Sequence: Synthetic polynucleotide
  modified_base (87)..(92): a, c, t, g, unknown or other
ctatctctaaatctaaatatttcaatataaaagttggaggctcatcgttcctattcccccccaggcagatgttatcgaggtccgacnnnnnntaaactctttatatatactaaactct

SEQ ID NO: 1758 - DNA, 118 bp, Artificial Sequence
  Description of Artificial Sequence: Synthetic polynucleotide
  modified_base (86)..(91): a, c, t, g, unknown or other
attaacattttaattcataccaaaactagttggaggctcatcgttcctattccccccccccaggcagatgttatcgaggtccgacnnnnnnaaacatatttaaataatataacctaaa

SEQ ID NO: 1759 - DNA, 118 bp, Artificial Sequence
  Description of Artificial Sequence: Synthetic polynucleotide
  modified_base (85)..(90): a, c, t, g, unknown or other
attttcccatccactaccctaaaaagttggaggctcatcgttcctattccccccccccccaggcagatgttatcgaggtccgacnnnnnnaatataaacattattttaactaccaata

SEQ ID NO: 1760 - DNA, 118 bp, Artificial Sequence
  Description of Artificial Sequence: Synthetic polynucleotide
  modified_base (89)..(94): a, c, t, g, unknown or other
acccatcaattattatctacaacacaaagttggaggctcatcgttcctattcccccccccccccaggcagatgttatcgaggtccgacnnnnnnaaaatattactactactcttaaaa

SEQ ID NO: 1761 - DNA, 118 bp, Artificial Sequence
  Description of Artificial Sequence: Synthetic polynucleotide
  modified_base (88)..(93): a, c, t, g, unknown or other
aaccactacccctccatcccccagttggaggctcatcgttcctattcccccccccccccccccaggcagatgttatcgaggtccgacnnnnnnaaaaacaatctataattacttttct

SEQ ID NO: 1762 - DNA, 118 bp, Artificial Sequence
  Description of Artificial Sequence: Synthetic polynucleotide
  modified_base (95)..(100): a, c, t, g, unknown or other
acctaatcctccacaacaaaaatcaagttggaggctcatcgttcctattcccccccccccccccccccccaggcagatgttatcgaggtccgacnnnnnntcaaaaccaaaccaacct

SEQ ID NO: 1763 - DNA, 118 bp, Artificial Sequence
  Description of Artificial Sequence: Synthetic polynucleotide
  modified_base (82)..(87): a, c, t, g, unknown or other
actaaccaaacccaaaagttggaggctcatcgttcctattcccccccccccccccccaggcagatgttatcgaggtccgacnnnnnnaaaacccttcaaattcattcattcattcatt

SEQ ID NO: 1764 - DNA, 118 bp, Artificial Sequence
  Description of Artificial Sequence: Synthetic polynucleotide
  modified_base (84)..(89): a, c, t, g, unknown or other
accttatctcacactaataatacctgttggaggctcatcgttcctattcccccccccccaggcagatgttatcgaggtccgacnnnnnnttaaaatcatcttatcttactaaaattta

SEQ ID NO: 1765 - DNA, 118 bp, Artificial Sequence
  Description of Artificial Sequence: Synthetic polynucleotide
  modified_base (91)..(96): a, c, t, g, unknown or other
atttaaattaaaatttttctattataccgttggaggctcatcgttcctattcccccccccccccccaggcagatgttatcgaggtccgacnnnnnnttaaatcttacaacaactaaaa

SEQ ID NO: 1766 - DNA, 118 bp, Artificial Sequence
  Description of Artificial Sequence: Synthetic polynucleotide
  modified_base (90)..(95): a, c, t, g, unknown or other
acctacaaacaaactccgttggaggctcatcgttcctattcccccccccccccccccccccccccaggcagatgttatcgaggtccgacnnnnnnaacctcctcctactcctactccc

SEQ ID NO: 1767 - DNA, 118 bp, Artificial Sequence
  Description of Artificial Sequence: Synthetic polynucleotide
  modified_base (83)..(88): a, c, t, g, unknown or other
actcaactaataataataaacctgttggaggctcatcgttcctattccccccccccccaggcagatgttatcgaggtccgacnnnnnnaaacctaacacttacccacatcactttata

SEQ ID NO: 1768 - DNA, 118 bp, Artificial Sequence
  Description of Artificial Sequence: Synthetic polynucleotide
  modified_base (97)..(102): a, c, t, g, unknown or other
aacaacaccaaaacccgttggaggctcatcgttcctattcccccccccccccccccccccccccccccccccaggcagatgttatcgaggtccgacnnnnnncccaacccataaaccc

SEQ ID NO: 1769 - DNA, 118 bp, Artificial Sequence
  Description of Artificial Sequence: Synthetic polynucleotide
  modified_base (90)..(95): a, c, t, g, unknown or other
atatatacataaccttaaataaaaaccgttggaggctcatcgttcctattcccccccccccccccaggcagatgttatcgaggtccgacnnnnnnttccttactattcctcacaaaaa

SEQ ID NO: 1770 - DNA, 118 bp, Artificial Sequence
  Description of Artificial Sequence: Synthetic polynucleotide
  modified_base (88)..(93): a, c, t, g, unknown or other
acctccaacaacaaactataaacaaatgttggaggctcatcgttcctattcccccccccccccaggcagatgttatcgaggtccgacnnnnnnatcctcattcttcttaaatataaaa

SEQ ID NO: 1771 - DNA, 118 bp, Artificial Sequence
  Description of Artificial Sequence: Synthetic polynucleotide
  modified_base (94)..(99): a, c, t, g, unknown or other
ataaaatctacaatatatctttcctaaacgttggaggctcatcgttcctattcccccccccccccccccaggcagatgttatcgaggtccgacnnnnnntcctctttccaaacaaaaa

SEQ ID NO: 1772 - DNA, 118 bp, Artificial Sequence
  Description of Artificial Sequence: Synthetic polynucleotide
  modified_base (82)..(87): a, c, t, g, unknown or other
atattactatttcctactatccaaagttggaggctcatcgttcctattcccccccccaggcagatgttatcgaggtccgacnnnnnntttaaaatttaattatatcctaaacctctca

SEQ ID NO: 1773 - DNA, 118 bp, Artificial Sequence
  Description of Artificial Sequence: Synthetic polynucleotide
  modified_base (95)..(100): a, c, t, g, unknown or other
ttcctaaatctccaatccgttggaggctcatcgttcctattcccccccccccccccccccccccccccccaggcagatgttatcgaggtccgacnnnnnnaaaactcccaaaccccac

SEQ ID NO: 1774 - DNA, 118 bp, Artificial Sequence
  Description of Artificial Sequence: Synthetic polynucleotide
  modified_base (93)..(98): a, c, t, g, unknown or other
aaatacatatattaaaaatataaaaatctaaagttggaggctcatcgttcctattcccccccccccccaggcagatgttatcgaggtccgacnnnnnnaaccacctatctaaacaaac

SEQ ID NO: 1775 - DNA, 118 bp, Artificial Sequence
  Description of Artificial Sequence: Synthetic polynucleotide
  modified_base (87)..(92): a, c, t, g, unknown or other
atccaacctatataaatacctgttggaggctcatcgttcctattccccccccccccccccccaggcagatgttatcgaggtccgacnnnnnnattctaaaaatctcatataaataaaa

SEQ ID NO: 1776 - DNA, 22 bp, Artificial Sequence
  Description of Artificial Sequence: Synthetic primer
gacgagctgatctccatcctca

SEQ ID NO: 1777 - DNA, 22 bp, Artificial Sequence
  Description of Artificial Sequence: Synthetic primer
atggactccacctggttatgcc

SEQ ID NO: 1778 - DNA, 22 bp, Artificial Sequence
  Description of Artificial Sequence: Synthetic primer
caccttctcctgtagcttcagc

SEQ ID NO: 1779 - DNA, 22 bp, Artificial Sequence
  Description of Artificial Sequence: Synthetic primer
aggagctactgctccaccttct

SEQ ID NO: 1780 - DNA, 22 bp, Artificial Sequence
  Description of Artificial Sequence: Synthetic primer
atgaccctgctggacacagagc

SEQ ID NO: 1781 - DNA, 22 bp, Artificial Sequence
  Description of Artificial Sequence: Synthetic primer
acggagttctctggctgcttca

SEQ ID NO: 1782 - DNA, 22 bp, Artificial Sequence
  Description of Artificial Sequence: Synthetic primer
caccattggcaatgagcggttc

SEQ ID NO: 1783 - DNA, 22 bp, Artificial Sequence
  Description of Artificial Sequence: Synthetic primer
aggtctttgcggatgtccacgt

SEQ ID NO: 1784 - DNA, 22 bp, Artificial Sequence
  Description of Artificial Sequence: Synthetic primer
ctacctctgcactgagaccaac

SEQ ID NO: 1785 - DNA, 22 bp, Artificial Sequence
  Description of Artificial Sequence: Synthetic primer
gtgcagttgctccattcacagc

SEQ ID NO: 1786 - DNA, 22 bp, Artificial Sequence
  Description of Artificial Sequence: Synthetic primer
caaggaggatcttagagccacc

SEQ ID NO: 1787 - DNA, 22 bp, Artificial Sequence
  Description of Artificial Sequence: Synthetic primer
tggcgagtatctccagcactag

SEQ ID NO: 1788 - DNA, 22 bp, Artificial Sequence
  Description of Artificial Sequence: Synthetic primer
ggctgtgctcaatgactggatg

SEQ ID NO: 1789 - DNA, 22 bp, Artificial Sequence
  Description of Artificial Sequence: Synthetic primer
gcccatccaataaacagagcgg

SEQ ID NO: 1790 - DNA, 22 bp, Artificial Sequence
  Description of Artificial Sequence: Synthetic primer
atggaggactctgccaaagcca

SEQ ID NO: 1791 - DNA, 23 bp, Artificial Sequence
  Description of Artificial Sequence: Synthetic primer
tggacatccagaagttagtcacc

SEQ ID NO: 1792 - DNA, 22 bp, Artificial Sequence
  Description of Artificial Sequence: Synthetic primer
cctggtgggtaggagatgagtt

SEQ ID NO: 1793 - DNA, 23 bp, Artificial Sequence
  Description of Artificial Sequence: Synthetic primer
gagaatggtggagaggatcatgg

SEQ ID NO: 1794 - DNA, 21 bp, Artificial Sequence
  Description of Artificial Sequence: Synthetic primer
gccactacctgtgcaacgcct

SEQ ID NO: 1795 - DNA, 22 bp, Artificial Sequence
  Description of Artificial Sequence: Synthetic primer
caatccaagccgccgtgatgaa

SEQ ID NO: 1796 - DNA, 21 bp, Artificial Sequence
  Description of Artificial Sequence: Synthetic primer
gccactacctgtgcaacgcct

SEQ ID NO: 1797 - DNA, 22 bp, Artificial Sequence
  Description of Artificial Sequence: Synthetic primer
caatccaagccgccgtgatgaa

SEQ ID NO: 1798 - DNA, 22 bp, Artificial Sequence
  Description of Artificial Sequence: Synthetic primer
gctcaggattccgctggaagaa

SEQ ID NO: 1799 - DNA, 22 bp, Artificial Sequence
  Description of Artificial Sequence: Synthetic primer
aggtcaccatttccacacgctg

SEQ ID NO: 1800 - DNA, 22 bp, Artificial Sequence
  Description of Artificial Sequence: Synthetic primer
tgaggcactgtgctcggaagtt

SEQ ID NO: 1801 - DNA, 22 bp, Artificial Sequence
  Description of Artificial Sequence: Synthetic primer
tcgaagagctgagacatcgcca

SEQ ID NO: 1802 - DNA, 22 bp, Artificial Sequence
  Description of Artificial Sequence: Synthetic primer
cattggcgggaccatcacttac

SEQ ID NO: 1803 - DNA, 23 bp, Artificial Sequence
  Description of Artificial Sequence: Synthetic primer
ccttcaggtatgtagggagcatc

SEQ ID NO: 1804 - DNA, 22 bp, Artificial Sequence
  Description of Artificial Sequence: Synthetic primer
cacttcctggaggtgaaactgg

SEQ ID NO: 1805 - DNA, 22 bp, Artificial Sequence
  Description of Artificial Sequence: Synthetic primer
gaaactccgtgcgctccttctt

SEQ ID NO: 1806 - DNA, 22 bp, Artificial Sequence
  Description of Artificial Sequence: Synthetic primer
gcttggaccaagaggaaactcc

SEQ ID NO: 1807 - DNA, 23 bp, Artificial Sequence
  Description of Artificial Sequence: Synthetic primer
caagtgggcatatttggcttccc

SEQ ID NO: 1808 - DNA, 24 bp, Artificial Sequence
  Description of Artificial Sequence: Synthetic primer
caccttccaaaatagcgagtatgg

SEQ ID NO: 1809 - DNA, 22 bp, Artificial Sequence
  Description of Artificial Sequence: Synthetic primer
atggttccgaccgagacgagtt

SEQ ID NO: 1810 - DNA, 23 bp, Artificial Sequence
  Description of Artificial Sequence: Synthetic primer
ctctcagagtgattctccaacgg

SEQ ID NO: 1811 - DNA, 23 bp, Artificial Sequence
  Description of Artificial Sequence: Synthetic primer
ggttctccacatgctgagtagag

SEQ ID NO: 1812 - DNA, 22 bp, Artificial Sequence
  Description of Artificial Sequence: Synthetic primer
aaatcacacggcgacctgtcgt

SEQ ID NO: 1813 - DNA, 22 bp, Artificial Sequence
  Description of Artificial Sequence: Synthetic primer
atggcatcctgaagcctcatcc

SEQ ID NO: 1814 - DNA, 24 bp, Artificial Sequence
  Description of Artificial Sequence: Synthetic primer
ggcttatgtgcaaaatggcagatc

SEQ ID NO: 1815 - DNA, 22 bp, Artificial Sequence
  Description of Artificial Sequence: Synthetic primer
gctcactccagcagttctgaag

SEQ ID NO: 1816 - DNA, 22 bp, Artificial Sequence
  Description of Artificial Sequence: Synthetic primer
caacggcatctccacagaagga

SEQ ID NO: 1817 - DNA, 23 bp, Artificial Sequence
  Description of Artificial Sequence: Synthetic primer
ccaaactctctgccacttcatcg

SEQ ID NO: 1818 - DNA, 22 bp, Artificial Sequence
  Description of Artificial Sequence: Synthetic primer
agcctcgttcacggttctatgc

SEQ ID NO: 1819 - DNA, 22 bp, Artificial Sequence
  Description of Artificial Sequence: Synthetic primer
gcagtgaccttctgcatccaga

SEQ ID NO: 1820 - DNA, 22 bp, Artificial Sequence
  Description of Artificial Sequence: Synthetic primer
gttggattgccgactggaagga

SEQ ID NO: 1821 - DNA, 22 bp, Artificial Sequence
  Description of Artificial Sequence: Synthetic primer
ctctcagactccaaggatgtgg

SEQ ID NO: 1822 - DNA, 23 bp, Artificial Sequence
  Description of Artificial Sequence: Synthetic primer
ggcaccttttatcgtttccaggc

SEQ ID NO: 1823 - DNA, 22 bp, Artificial Sequence
  Description of Artificial Sequence: Synthetic primer
tctgccagttccagccttgctt

SEQ ID NO: 1824 - DNA, 23 bp, Artificial Sequence
  Description of Artificial Sequence: Synthetic primer
gttcagtgttggcagcaatgagc

SEQ ID NO: 1825 - DNA, 22 bp, Artificial Sequence
  Description of Artificial Sequence: Synthetic primer
agcacagtagccgtggcattgt

SEQ ID NO: 1826 - DNA, 22 bp, Artificial Sequence
  Description of Artificial Sequence: Synthetic primer
tgtccagatgctgtgccttcct

SEQ ID NO: 1827 - DNA, 22 bp, Artificial Sequence
  Description of Artificial Sequence: Synthetic primer
ctcgtcttctcctcccagtatg

SEQ ID NO: 1828 - DNA, 22 bp, Artificial Sequence
  Description of Artificial Sequence: Synthetic primer
gtctgtggatgacctggctaac

SEQ ID NO: 1829 - DNA, 22 bp, Artificial Sequence
  Description of Artificial Sequence: Synthetic primer
gacatcggtctgcttgaaggac

SEQ ID NO: 1830 - DNA, 18 bp, Artificial Sequence
  Description of Artificial Sequence: Synthetic oligonucleotide
gggaaggaggtttagttg

SEQ ID NO: 1831 - DNA, 18 bp, Artificial Sequence
  Description of Artificial Sequence: Synthetic oligonucleotide
caaacccacacctactac

SEQ ID NO: 1832 - DNA, 26 bp, Artificial Sequence
  Description of Artificial Sequence: Synthetic oligonucleotide
  modified_base (19)..(19): Inosine
agttttttttcgtattttngttaggt

SEQ ID NO: 1833 - DNA, 30 bp, Artificial Sequence
  Description of Artificial Sequence: Synthetic oligonucleotide
  modified_base (23)..(23): Inosine
ttatagtttttttttgtattttngttaggt

SEQ ID NO: 1834 - DNA, 15 bp, Artificial Sequence
  Description of Artificial Sequence: Synthetic oligonucleotide
ggtttgggggttttg

SEQ ID NO: 1835 - DNA, 22 bp, Artificial Sequence
  Description of Artificial Sequence: Synthetic oligonucleotide
  modified_base (4)..(4): Inosine
gacngcatataactaataataa

SEQ ID NO: 1836 - DNA, 20 bp, Artificial Sequence
  Description of Artificial Sequence: Synthetic oligonucleotide
ggtggtcgttagttgtttgg

SEQ ID NO: 1837 - DNA, 21 bp, Artificial Sequence
  Description of Artificial Sequence: Synthetic oligonucleotide
ggtggttgttagttgtttggt

SEQ ID NO: 1838 - DNA, 16 bp, Artificial Sequence
  Description of Artificial Sequence: Synthetic oligonucleotide
gtaggaggggtgtgtg

SEQ ID NO: 1839 - DNA, 21 bp, Artificial Sequence
  Description of Artificial Sequence: Synthetic oligonucleotide
  modified_base (6)..(6): Inosine
acaatngacttacccaataaa

SEQ ID NO: 1840 - DNA, 18 bp, Artificial Sequence
  Description of Artificial Sequence: Synthetic oligonucleotide
  modified_base (3)..(3): Inosine
agnggaagtcggaagttt

SEQ ID NO: 1841 - DNA, 21 bp, Artificial Sequence
  Description of Artificial Sequence: Synthetic oligonucleotide
  modified_base (3)..(3): Inosine
agnggaagttggaagttttag

SEQ ID NO: 1842 - DNA, 16 bp, Artificial Sequence
  Description of Artificial Sequence: Synthetic oligonucleotide
  modified_base (6)..(6): Inosine
agtatngggagaaggt

SEQ ID NO: 1843 - DNA, 22 bp, Artificial Sequence
  Description of Artificial Sequence: Synthetic oligonucleotide
cccttcatcttcaaataaaaaa

SEQ ID NO: 1844 - DNA, 17 bp, Artificial Sequence
  Description of Artificial Sequence: Synthetic oligonucleotide
  modified_base (15)..(15): Inosine
ttttagggcgtgtgnga

SEQ ID NO: 1845 - DNA, 19 bp, Artificial Sequence
  Description of Artificial Sequence: Synthetic oligonucleotide
  modified_base (17)..(17): Inosine
agttttagggtgtgtgnga

SEQ ID NO: 1846 - DNA, 23 bp, Artificial Sequence
  Description of Artificial Sequence: Synthetic oligonucleotide
atatttgtttggtttgatttagg

SEQ ID NO: 1847 - DNA, 23 bp, Artificial Sequence
  Description of Artificial Sequence: Synthetic oligonucleotide
ccaatcaataaaaatacactcta

SEQ ID NO: 1848 - DNA, 24 bp, Artificial Sequence
  Description of Artificial Sequence: Synthetic oligonucleotide
attttaggtttgcgtgagttattg

SEQ ID NO: 1849 - DNA, 26 bp, Artificial Sequence
  Description of Artificial Sequence: Synthetic oligonucleotide
attttaggtttgtgtgagttattgga

SEQ ID NO: 1850 - DNA, 21 bp, Artificial Sequence
  Description of Artificial Sequence: Synthetic oligonucleotide
ttttaggattgggtagtttag

SEQ ID NO: 1851 - DNA, 15 bp, Artificial Sequence
  Description of Artificial Sequence: Synthetic oligonucleotide
cccacccacatactc

SEQ ID NO: 1852 - DNA, 19 bp, Artificial Sequence
  Description of Artificial Sequence: Synthetic oligonucleotide
  modified_base (2)..(2): Inosine
tngatgagcggattgatgt

SEQ ID NO: 1853 - DNA, 22 bp, Artificial Sequence
  Description of Artificial Sequence: Synthetic oligonucleotide
  modified_base (2)..(2): Inosine
tngatgagtggattgatgtttg

SEQ ID NO: 1854 - DNA, 22 bp, Artificial Sequence
  Description of Artificial Sequence: Synthetic oligonucleotide
aaagggttttaggtagagtttg

SEQ ID NO: 1855 - DNA, 26 bp, Artificial Sequence
  Description of Artificial Sequence: Synthetic oligonucleotide
gaactaaattccctcttatatctttc

SEQ ID NO: 1856 - DNA, 25 bp, Artificial Sequence
  Description of Artificial Sequence: Synthetic oligonucleotide
  modified_base (22)..(22): Inosine
ggaagatagtttcgtttttttngga

SEQ ID NO: 1857 - DNA, 27 bp, Artificial Sequence
  Description of Artificial Sequence: Synthetic oligonucleotide
  modified_base (23)..(23): Inosine
aggaagatagttttgtttttttnggaa

SEQ ID NO: 1858 - DNA, 18 bp, Artificial Sequence
  Description of Artificial Sequence: Synthetic oligonucleotide
ggagaggaggatttagag

SEQ ID NO: 1859 - DNA, 19 bp, Artificial Sequence
  Description of Artificial Sequence: Synthetic oligonucleotide
ctccacaatcttcaaaaac

SEQ ID NO: 1860 - DNA, 20 bp, Artificial Sequence
  Description of Artificial Sequence: Synthetic oligonucleotide
  modified_base (18)..(18): Inosine
attggggagtcgtatatngg

SEQ ID NO: 1861 - DNA, 23 bp, Artificial Sequence
  Description of Artificial Sequence: Synthetic oligonucleotide
  modified_base (21)..(21): Inosine
gttattggggagttgtatatngg

SEQ ID NO: 1862 - DNA, 22 bp, Artificial Sequence
  Description of Artificial Sequence: Synthetic oligonucleotide
ttagtggagtggtagttttaga

SEQ ID NO: 1863 - DNA, 23 bp, Artificial Sequence
  Description of Artificial Sequence: Synthetic oligonucleotide
tcaaaaactaaacctcaaataca

SEQ ID NO: 1864 - DNA, 17 bp, Artificial Sequence
  Description of Artificial Sequence: Synthetic oligonucleotide
  modified_base (4)..(4): Inosine
aggnggttcggtattgg

SEQ ID NO: 1865 - DNA, 18 bp, Artificial Sequence
  Description of Artificial Sequence: Synthetic oligonucleotide
  modified_base (4)..(4): Inosine
aggnggtttggtattggg

SEQ ID NO: 1866 - DNA, 19 bp, Artificial Sequence
  Description of Artificial Sequence: Synthetic oligonucleotide
  modified_base (7)..(7): Inosine
tgtggangagttattagta

SEQ ID NO: 1867 - DNA, 19 bp, Artificial Sequence
  Description of Artificial Sequence: Synthetic oligonucleotide
  modified_base (2)..(2): Inosine
angaaacccaaccaataaa

SEQ ID NO: 1868 - DNA, 25 bp, Artificial Sequence
  Description of Artificial Sequence: Synthetic oligonucleotide
gtttggttacgtagggtttttttag

SEQ ID NO: 1869 - DNA, 26 bp, Artificial Sequence
  Description of Artificial Sequence: Synthetic oligonucleotide
gtttggttatgtagggtttttttagg

SEQ ID NO: 1870 - DNA, 21 bp, Artificial Sequence
  Description of Artificial Sequence: Synthetic oligonucleotide
tgttagtttttatggaagttt

SEQ ID NO: 1871 - DNA, 20 bp, Artificial Sequence
  Description of Artificial Sequence: Synthetic oligonucleotide
  modified_base (4)..(4): Inosine
aaangaacaaaatactcaaa

SEQ ID NO: 1872 - DNA, 16 bp, Artificial Sequence
  Description of Artificial Sequence: Synthetic oligonucleotide
tgggagagcgggagat

SEQ ID NO: 1873 - DNA, 20 bp, Artificial Sequence
  Description of Artificial Sequence: Synthetic oligonucleotide
tttgggagagtgggagattt

SEQ ID NO: 1874 - DNA, 21 bp, Artificial Sequence
  Description of Artificial Sequence: Synthetic oligonucleotide
gttttataaggaggttgtgtt

SEQ ID NO: 1875 - DNA, 18 bp, Artificial Sequence
  Description of Artificial Sequence: Synthetic oligonucleotide
  modified_base (3)..(3): Inosine
aangaaaaaccctccaaa

SEQ ID NO: 1876 - DNA, 17 bp, Artificial Sequence
  Description of Artificial Sequence: Synthetic oligonucleotide
gaggggtcggatgttgg

SEQ ID NO: 1877 - DNA, 18 bp, Artificial Sequence
  Description of Artificial Sequence: Synthetic oligonucleotide
gaggggttggatgttggg

SEQ ID NO: 1878 - DNA, 16 bp, Artificial Sequence
  Description of Artificial Sequence: Synthetic oligonucleotide
ggttatggggaggttg

SEQ ID NO: 1879 - DNA, 16 bp, Artificial Sequence
  Description of Artificial Sequence: Synthetic oligonucleotide
  modified_base (3)..(3): Inosine
gcngaaacttaaccac

SEQ ID NO: 1880 - DNA, 17 bp, Artificial Sequence
  Description of Artificial Sequence: Synthetic oligonucleotide
  modified_base (16)..(16): Inosine
ggtagtggtacggagng

SEQ ID NO: 1881 - DNA, 18 bp, Artificial Sequence
  Description of Artificial Sequence: Synthetic oligonucleotide
  modified_base (15)..(15): Inosine
  modified_base (17)..(17): Inosine
gtagtggtatggagngng

SEQ ID NO: 1882 - DNA, 21 bp, Artificial Sequence
  Description of Artificial Sequence: Synthetic oligonucleotide
gatttgttgttgttgttttag

SEQ ID NO: 1883 - DNA, 18 bp, Artificial Sequence
  Description of Artificial Sequence: Synthetic oligonucleotide
  modified_base (2)..(2): Inosine
cngcaacataatcttacc

SEQ ID NO: 1884 - DNA, 22 bp, Artificial Sequence
  Description of Artificial Sequence: Synthetic oligonucleotide
  modified_base (3)..(3): Inosine
  modified_base (19)..(19): Inosine
gtnggatattgacgtttangtt

SEQ ID NO: 1885 - DNA, 25 bp, Artificial Sequence
  Description of Artificial Sequence: Synthetic oligonucleotide
  modified_base (6)..(6): Inosine
  modified_base (22)..(22): Inosine
atagtnggatattgatgtttangtt

SEQ ID NO: 1886 - DNA, 23 bp, Artificial Sequence
  Description of Artificial Sequence: Synthetic oligonucleotide
atggtatattgtagagtaatttg

SEQ ID NO: 1887 - DNA, 16 bp, Artificial Sequence
  Description of Artificial Sequence: Synthetic oligonucleotide
  modified_base (2)..(2): Inosine
angccttctttcttca

SEQ ID NO: 1888 - DNA, 17 bp, Artificial Sequence
  Description of Artificial Sequence: Synthetic oligonucleotide
  modified_base (10)..(10): Inosine
agttggtcgngtaggag

SEQ ID NO: 1889 - DNA, 18 bp, Artificial Sequence
  Description of Artificial Sequence: Synthetic oligonucleotide
  modified_base (10)..(10): Inosine
agttggttgngtaggagg

SEQ ID NO: 1890 - DNA, 20 bp, Artificial Sequence
  Description of Artificial Sequence: Synthetic oligonucleotide
ggtgatgtttgttattatgt

SEQ ID NO: 1891 - DNA, 25 bp, Artificial Sequence
  Description of Artificial Sequence: Synthetic oligonucleotide
  modified_base (3)..(3): Inosine
aangactaatataaaacttaatctc

SEQ ID NO: 1892 - DNA, 27 bp, Artificial Sequence
  Description of Artificial Sequence: Synthetic oligonucleotide
  modified_base (16)..(16): Inosine
tttttattattgcgtngttgtttatga

SEQ ID NO: 1893 - DNA, 29 bp, Artificial Sequence
  Description of Artificial Sequence: Synthetic oligonucleotide
  modified_base (16)..(16): Inosine
tttttattattgtgtngttgtttatgatg

SEQ ID NO: 1894 - DNA, 19 bp, Artificial Sequence
  Description of Artificial Sequence: Synthetic oligonucleotide
  modified_base (10)..(10): Inosine
gttatgtgangagattagg

SEQ ID NO: 1895 - DNA, 15 bp, Artificial Sequence
  Description of Artificial Sequence: Synthetic oligonucleotide
  modified_base (3)..(3): Inosine
ccngccaaacacaac

SEQ ID NO: 1896 - DNA, 26 bp, Artificial Sequence
  Description of Artificial Sequence: Synthetic oligonucleotide
  modified_base (10)..(10): Inosine
  modified_base (22)..(22): Inosine
attttaattnggcgattttttngaag

SEQ ID NO: 1897 - DNA, 27 bp, Artificial Sequence
  Description of Artificial Sequence: Synthetic oligonucleotide
  modified_base (10)..(10): Inosine
  modified_base (22)..(22): Inosine
attttaattnggtgattttttngaaga

SEQ ID NO: 1898 - DNA, 26 bp, Artificial Sequence
  Description of Artificial Sequence: Synthetic oligonucleotide
gtggttattatgtttttgatatttgt

SEQ ID NO: 1899 - DNA, 25 bp, Artificial Sequence
  Description of Artificial Sequence: Synthetic oligonucleotide
cccattattcatacttaccttctta

SEQ ID NO: 1900 - DNA, 22 bp, Artificial Sequence
  Description of Artificial Sequence: Synthetic oligonucleotide
  modified_base (14)..(14): Inosine
ttttgaatgatcgnggttaggg

SEQ ID NO: 1901 - DNA, 23 bp, Artificial Sequence
  Description of Artificial Sequence: Synthetic oligonucleotide
  modified_base (14)..(14): Inosine
ttttgaatgattgnggttagggg

SEQ ID NO: 1902 - DNA, 19 bp, Artificial Sequence
  Description of Artificial Sequence: Synthetic oligonucleotide
gtaatggtggtagaggaat

SEQ ID NO: 1903 - DNA, 25 bp, Artificial Sequence
  Description of Artificial Sequence: Synthetic oligonucleotide
aaaactaaactaaactctacaaaaa

SEQ ID NO: 1904 - DNA, 29 bp, Artificial Sequence
  Description of Artificial Sequence: Synthetic oligonucleotide
tgtgaaattttcgtttgtataatttttgg

SEQ ID NO: 1905 - DNA, 30 bp, Artificial Sequence
  Description of Artificial Sequence: Synthetic oligonucleotide
tgtgaaatttttgtttgtataatttttggg

SEQ ID NO: 1906 - DNA, 22 bp, Artificial Sequence
  Description of Artificial Sequence: Synthetic oligonucleotide
  modified_base (3)..(3): Inosine
gtngtagatgatttgtattagg

SEQ ID NO: 1907 - DNA, 16 bp, Artificial Sequence
  Description of Artificial Sequence: Synthetic oligonucleotide
ccccacaacaacaact

SEQ ID NO: 1908 - DNA, 21 bp, Artificial Sequence
  Description of Artificial Sequence: Synthetic oligonucleotide
  modified_base (2)..(2): Inosine
gnggtgatacgggttttttag

SEQ ID NO: 1909 - DNA, 22 bp, Artificial Sequence
  Description of Artificial Sequence: Synthetic oligonucleotide
  modified_base (2)..(2): Inosine
gnggtgatatgggttttttagg

SEQ ID NO: 1910 - DNA, 19 bp, Artificial Sequence
  Description of Artificial Sequence: Synthetic oligonucleotide
ttaggggttatggaaggag

SEQ ID NO: 1911 - DNA, 20 bp, Artificial Sequence
  Description of Artificial Sequence: Synthetic oligonucleotide
cactttaaccacttcctttt

SEQ ID NO: 1912 - DNA, 23 bp, Artificial Sequence
  Description of Artificial Sequence: Synthetic oligonucleotide
gattagggcgaatttgttgtttg

SEQ ID NO: 1913 - DNA, 25 bp, Artificial Sequence
  Description of Artificial Sequence: Synthetic oligonucleotide
gattagggtgaatttgttgtttgtg

SEQ ID NO: 1914 - DNA, 23 bp, Artificial Sequence
  Description of Artificial Sequence: Synthetic oligonucleotide
gattttttatagggtttgttgat

SEQ ID NO: 1915 - DNA, 24 bp, Artificial Sequence
  Description of Artificial Sequence: Synthetic oligonucleotide
  modified_base (8)..(8): Inosine
  modified_base (10)..(10): Inosine
cataaaangngaaattaaaaacca

SEQ ID NO: 1916-1917 - skipped (2 entries)

SEQ ID NO: 1918 - DNA, 22 bp, Artificial Sequence
  Description of Artificial Sequence: Synthetic oligonucleotide
  modified_base (1)..(1): Inosine
ngttgagtatattagttgtttt

SEQ ID NO: 1919 - DNA, 16 bp, Artificial Sequence
  Description of Artificial Sequence: Synthetic oligonucleotide
  modified_base (7)..(7): Inosine
aactacngccctaacc

SEQ ID NO: 1920 - DNA, 22 bp, Artificial Sequence
  Description of Artificial Sequence: Synthetic oligonucleotide
  modified_base (7)..(7): Inosine
atgtagngtttcgtagttgtag

SEQ ID NO: 1921 - DNA, 23 bp, Artificial Sequence
  Description of Artificial Sequence: Synthetic oligonucleotide
  modified_base (7)..(7): Inosine
atgtagngttttgtagttgtagg

SEQ ID NO: 1922 - DNA, 21 bp, Artificial Sequence
  Description of Artificial Sequence: Synthetic oligonucleotide
tgattttaggaaaggtttaga

SEQ ID NO: 1923 - DNA, 21 bp, Artificial Sequence
  Description of Artificial Sequence: Synthetic oligonucleotide
taccaaaccaacaaaatacaa

SEQ ID NO: 1924 - DNA, 22 bp, Artificial Sequence
  Description of Artificial Sequence: Synthetic oligonucleotide
atagggttgtcgtgagaatagt

SEQ ID NO: 1925 - DNA, 24 bp, Artificial Sequence
  Description of Artificial Sequence: Synthetic oligonucleotide
gatagggttgttgtgagaatagtg

SEQ ID NO: 1926 - DNA, 24 bp, Artificial Sequence
  Description of Artificial Sequence: Synthetic oligonucleotide
aggaggtttttatagttttatggt

SEQ ID NO: 1927 - DNA, 22 bp, Artificial Sequence
  Description of Artificial Sequence: Synthetic oligonucleotide
aaaaactcccctccaataaaaa

SEQ ID NO: 1928 - DNA, 13 bp, Artificial Sequence
  Description of Artificial Sequence: Synthetic oligonucleotide
  modified_base (10)..(10): Inosine
agggtcgggnggt

SEQ ID NO: 1929 - DNA, 14 bp, Artificial Sequence
  Description of Artificial Sequence: Synthetic oligonucleotide
  modified_base (10)..(10): Inosine
agggttgggnggtg

SEQ ID NO: 1930 - DNA, 16 bp, Artificial Sequence
  Description of Artificial Sequence: Synthetic oligonucleotide
aggggttaggagttac

SEQ ID NO: 1931 - DNA, 20 bp, Artificial Sequence
  Description of Artificial Sequence: Synthetic oligonucleotide
aaaaccaataaattccaaaa

SEQ ID NO: 1932 - DNA, 14 bp, Artificial Sequence
  Description of Artificial Sequence: Synthetic oligonucleotide
gaggggcgtgggtg

SEQ ID NO: 1933 - DNA, 15 bp, Artificial Sequence
  Description of Artificial Sequence: Synthetic oligonucleotide
ggaggggtgtgggtg

SEQ ID NO: 1934 - DNA, 20 bp, Artificial Sequence
  Description of Artificial Sequence: Synthetic oligonucleotide
  modified_base (6)..(6): Inosine
gagttngtttttagttttag

SEQ ID NO: 1935 - DNA, 15 bp, Artificial Sequence
  Description of Artificial Sequence: Synthetic oligonucleotide
tccctctcctttctc

SEQ ID NO: 1936 - DNA, 22 bp, Artificial Sequence
  Description of Artificial Sequence: Synthetic oligonucleotide
  modified_base (20)..(20): Inosine
gtgttagggttttcgtattngt

SEQ ID NO: 1937 - DNA, 23 bp, Artificial Sequence
  Description of Artificial Sequence: Synthetic oligonucleotide
  modified_base (21)..(21): Inosine
agtgttagggtttttgtattngt

SEQ ID NO: 1938 - DNA, 28 bp, Artificial Sequence
  Description of Artificial Sequence: Synthetic oligonucleotide
tgtgtaatagtttattagattgatagag

SEQ ID NO: 1939 - DNA, 23 bp, Artificial Sequence
  Description of Artificial Sequence: Synthetic oligonucleotide
aacacaaacaatactaactactt

SEQ ID NO: 1940 - DNA, 27 bp, Artificial Sequence
  Description of Artificial Sequence: Synthetic oligonucleotide
gatggatgtttacgttgtttataaatt

SEQ ID NO: 1941 - DNA, 28 bp, Artificial Sequence
  Description of Artificial Sequence: Synthetic oligonucleotide
ggatggatgtttatgttgtttataaatt

SEQ ID NO: 1942 - DNA, 25 bp, Artificial Sequence
  Description of Artificial Sequence: Synthetic oligonucleotide
ggggatttgttttagttatttaaag

SEQ ID NO: 1943 - DNA, 24 bp, Artificial Sequence
  Description of Artificial Sequence: Synthetic oligonucleotide
aaaaaattaaacaaacacctctac

SEQ ID NO: 1944 - DNA, 21 bp, Artificial Sequence
  Description of Artificial Sequence: Synthetic oligonucleotide
ttgattggatcggttgagttg

SEQ ID NO: 1945 - DNA, 22 bp, Artificial Sequence
  Description of Artificial Sequence: Synthetic oligonucleotide
ttgattggattggttgagttgt

SEQ ID NO: 1946 - DNA, 20 bp, Artificial Sequence
  Description of Artificial Sequence: Synthetic oligonucleotide
gtgaggatttgtttgttttg

SEQ ID NO: 1947 - DNA, 20 bp, Artificial Sequence
  Description of Artificial Sequence: Synthetic oligonucleotide
aaactcccacttaaaaacac

SEQ ID NO: 1948 - DNA, 24 bp, Artificial Sequence
  Description of Artificial Sequence: Synthetic oligonucleotide
agttaggttcggttttttttaggg

SEQ ID NO: 1949 - DNA, 26 bp, Artificial Sequence
  Description of Artificial Sequence: Synthetic oligonucleotide
gtagttaggtttggttttttttaggg

SEQ ID NO: 1950 - DNA, 19 bp, Artificial Sequence
  Description of Artificial Sequence: Synthetic oligonucleotide
ggggttaggagaggataaa

SEQ ID NO: 1951 - DNA, 24 bp, Artificial Sequence
  Description of Artificial Sequence: Synthetic oligonucleotide
aaacatatatcaccaaaactcaaa

SEQ ID NO: 1952 - DNA, 27 bp, Artificial Sequence
  Description of Artificial Sequence: Synthetic oligonucleotide
  modified_base (25)..(25): Inosine
agtttgtagtataaatcgtattatngt

SEQ ID NO: 1953 - DNA, 29 bp, Artificial Sequence
  Description of Artificial Sequence: Synthetic oligonucleotide
  modified_base (26)..(26): Inosine
tagtttgtagtataaattgtattatngta

SEQ ID NO: 1954 - DNA, 25 bp, Artificial Sequence
  Description of Artificial Sequence: Synthetic oligonucleotide
  modified_base (8)..(8): Inosine
tagttatnggagatttttatttaat

SEQ ID NO: 1955 - DNA, 22 bp, Artificial Sequence
  Description of Artificial Sequence: Synthetic oligonucleotide
acttccttcctataactttttt

SEQ ID NO: 1956 - DNA, 28 bp, Artificial Sequence
  Description of Artificial Sequence: Synthetic oligonucleotide
aatagtaatcgtattttttagaaagagt

SEQ ID NO: 1957 - DNA, 30 bp, Artificial Sequence
  Description of Artificial Sequence: Synthetic oligonucleotide
taaatagtaattgtattttttagaaagagt

SEQ ID NO: 1958 - DNA, 23 bp, Artificial Sequence
  Description of Artificial Sequence: Synthetic oligonucleotide
taggattgattttgtttttaaga

SEQ ID NO: 1959 - DNA, 23 bp, Artificial Sequence
  Description of Artificial Sequence: Synthetic oligonucleotide
caataaacaacacataaactttc

SEQ ID NO: 1960 - DNA, 24 bp, Artificial Sequence
  Description of Artificial Sequence: Synthetic oligonucleotide
tagttttttatcgaggtaggtagg

SEQ ID NO: 1961 - DNA, 26 bp, Artificial Sequence
  Description of Artificial Sequence: Synthetic oligonucleotide
ttagttttttattgaggtaggtagga

SEQ ID NO: 1962 - DNA, 15 bp, Artificial Sequence
  Description of Artificial Sequence: Synthetic oligonucleotide
  modified_base (3)..(3): Inosine
gtnggatggggttga

SEQ ID NO: 1963 - DNA, 20 bp, Artificial Sequence
  Description of Artificial Sequence: Synthetic oligonucleotide
tacttcctaaccaaaataca

SEQ ID NO: 1964 - DNA, 25 bp, Artificial Sequence
  Description of Artificial Sequence: Synthetic oligonucleotide
tttttttagcgtttgttgtagttgt

SEQ ID NO: 1965 - DNA, 28 bp, Artificial Sequence
  Description of Artificial Sequence: Synthetic oligonucleotide
tattttttttagtgtttgttgtagttgt

SEQ ID NO: 1966 - DNA, 20 bp, Artificial Sequence
  Description of Artificial Sequence: Synthetic oligonucleotide
ggtgtaaaggtggttttgta

SEQ ID NO: 1967 - DNA, 26 bp, Artificial Sequence
  Description of Artificial Sequence: Synthetic oligonucleotide
attaactaacacacaaaactctaaat

SEQ ID NO: 1968 - DNA, 22 bp, Artificial Sequence
  Description of Artificial Sequence: Synthetic oligonucleotide
  modified_base (7)..(7): Inosine
gtttttnggaagtcgttaggtg

SEQ ID NO: 1969 - DNA, 23 bp, Artificial Sequence
  Description of Artificial Sequence: Synthetic oligonucleotide
  modified_base (7)..(7): Inosine
gtttttnggaagttgttaggtga

SEQ ID NO: 1970 - DNA, 21 bp, Artificial Sequence
  Description of Artificial Sequence: Synthetic oligonucleotide
  modified_base (3)..(3): Inosine
ttngagtttggtagattagta

SEQ ID NO: 1971 - DNA, 25 bp, Artificial Sequence
  Description of Artificial Sequence: Synthetic oligonucleotide
caatcttcataacaaaacaaaaata

SEQ ID NO: 1972 - DNA, 23 bp, Artificial Sequence
  Description of Artificial Sequence: Synthetic oligonucleotide
  modified_base (4)..(4): Inosine
tttnggtttttcggggttattag

SEQ ID NO: 1973 - DNA, 24 bp, Artificial Sequence
  Description of Artificial Sequence: Synthetic oligonucleotide
  modified_base (4)..(4): Inosine
tttnggttttttggggttattagg

SEQ ID NO: 1974 - DNA, 25 bp, Artificial Sequence
  Description of Artificial Sequence: Synthetic oligonucleotide
gagtgattgatattgtttttgttta

SEQ ID NO: 1975 - DNA, 22 bp, Artificial Sequence
  Description of Artificial Sequence: Synthetic oligonucleotide
accaaacaccaatttcctatta

SEQ ID NO: 1976 - DNA, 31 bp, Artificial Sequence
  Description of Artificial Sequence: Synthetic oligonucleotide
aataaaaaaaatcggtgtttttatatttagt

SEQ ID NO: 1977 - DNA, 32 bp, Artificial Sequence
  Description of Artificial Sequence: Synthetic oligonucleotide
aaataaaaaaaattggtgtttttatatttagt

SEQ ID NO: 1978 - DNA, 23 bp, Artificial Sequence
  Description of Artificial Sequence: Synthetic oligonucleotide
ttagatttgttttgaaagtagaa

SEQ ID NO: 1979 - DNA, 28 bp, Artificial Sequence
  Description of Artificial Sequence: Synthetic oligonucleotide
ccataaaactatctattttcaataatac

SEQ ID NO: 1980 - DNA, 27 bp, Artificial Sequence
  Description of Artificial Sequence: Synthetic oligonucleotide
aatagttaatcgttgtttatattgggg

SEQ ID NO: 1981 - DNA, 28 bp, Artificial Sequence
  Description of Artificial Sequence: Synthetic oligonucleotide
aatagttaattgttgtttatattggggt

SEQ ID NO: 1982 - DNA, 15 bp, Artificial Sequence
  Description of Artificial Sequence: Synthetic oligonucleotide
  modified_base (4)..(4): Inosine
ggangatgtgaagga

SEQ ID NO: 1983 - DNA, 21 bp, Artificial Sequence
  Description of Artificial Sequence: Synthetic oligonucleotide
  modified_base (2)..(2): Inosine
angaacaacaattaaactaaa

SEQ ID NO: 1984 - DNA, 25 bp, Artificial Sequence
  Description of Artificial Sequence: Synthetic oligonucleotide
  modified_base (22)..(22): Inosine
tgtttttaagaacgattttttnggt

SEQ ID NO: 1985 - DNA, 28 bp, Artificial Sequence
  Description of Artificial Sequence: Synthetic oligonucleotide
  modified_base (24)..(24): Inosine
tatgtttttaagaatgattttttnggtt

SEQ ID NO: 1986 - DNA, 22 bp, Artificial Sequence
  Description of Artificial Sequence: Synthetic oligonucleotide
tagtagtagtaggaggaggtag

SEQ ID NO: 1987 - DNA, 22 bp, Artificial Sequence
  Description of Artificial Sequence: Synthetic oligonucleotide
aatacacaacccaataacaaac

SEQ ID NO: 1988 - DNA, 28 bp, Artificial Sequence
  Description of Artificial Sequence: Synthetic oligonucleotide
  modified_base (17)..(17): Inosine
ttttttagttaaacgtngattaaggtat

SEQ ID NO: 1989 - DNA, 30 bp, Artificial Sequence
  Description of Artificial Sequence: Synthetic oligonucleotide
ttttttagttaaatgttgattaaggtatag

SEQ ID NO: 1990 - DNA, 15 bp, Artificial Sequence
  Description of Artificial Sequence: Synthetic oligonucleotide
  modified_base (3)..(3): Inosine
ggngtttgggattgg

SEQ ID NO: 1991 - DNA, 16 bp, Artificial Sequence
  Description of Artificial Sequence: Synthetic oligonucleotide
acaaacccctacaacc

SEQ ID NO: 1992 - DNA, 16 bp, Artificial Sequence
  Description of Artificial Sequence: Synthetic oligonucleotide
  modified_base (4)..(4): Inosine
  modified_base (14)..(14): Inosine
ggtngagcgtgttngt

SEQ ID NO: 1993 - DNA, 18 bp, Artificial Sequence
  Description of Artificial Sequence: Synthetic oligonucleotide
  modified_base (6)..(6): Inosine
  modified_base (16)..(16): Inosine
gaggtngagtgtgttngt

SEQ ID NO: 1994 - DNA, 17 bp, Artificial Sequence
  Description of Artificial Sequence: Synthetic oligonucleotide
ggggtttatggtgtagg

SEQ ID NO: 1995 - DNA, 15 bp, Artificial Sequence
  Description of Artificial Sequence: Synthetic oligonucleotide
accacccctcaaact

SEQ ID NO: 1996 - DNA, 18 bp, Artificial Sequence
  Description of Artificial Sequence: Synthetic oligonucleotide
  modified_base (15)..(15): Inosine
tgttttaggcggttnggg

SEQ ID NO: 1997 - DNA, 20 bp, Artificial Sequence
  Description of Artificial Sequence: Synthetic oligonucleotide
  modified_base (15)..(15): Inosine
tgttttaggtggttngggtg

SEQ ID NO: 1998 - DNA, 21 bp, Artificial Sequence
  Description of Artificial Sequence: Synthetic oligonucleotide
agtgttgatgtttagtaaatg

SEQ ID NO: 1999 - DNA, 23 bp, Artificial Sequence
  Description of Artificial Sequence: Synthetic oligonucleotide
cccaatatctaacactataaatc

SEQ ID NO: 2000 - DNA, 29 bp, Artificial Sequence
  Description of Artificial Sequence: Synthetic oligonucleotide
atattattgtggaatcgttttatttttgt

SEQ ID NO: 2001 - DNA, 31 bp, Artificial Sequence
  Description of Artificial Sequence: Synthetic oligonucleotide
atattattgtggaattgttttatttttgttt

SEQ ID NO: 2002 - DNA, 21 bp, Artificial Sequence
  Description of Artificial Sequence: Synthetic oligonucleotide
tttgttgaaagttaggattag

SEQ ID NO: 2003 - DNA, 23 bp, Artificial Sequence
  Description of Artificial Sequence: Synthetic oligonucleotide
ccttcccatatttatcaataaac

SEQ ID NO: 2004 - DNA, 30 bp, Artificial Sequence
  Description of Artificial Sequence: Synthetic oligonucleotide
tgttatagtttattaaagacgttagtgaga

SEQ ID NO: 2005 - DNA, 32 bp, Artificial Sequence
  Description of Artificial Sequence: Synthetic oligonucleotide
tgttatagtttattaaagatgttagtgagata

SEQ ID NO: 2006 - DNA, 27 bp, Artificial Sequence
  Description of Artificial Sequence: Synthetic oligonucleotide
gagatatttgtggtagttataatttag

SEQ ID NO: 2007 - DNA, 28 bp, Artificial Sequence
  Description of Artificial Sequence: Synthetic oligonucleotide
attatacaataacaacccaaaattactc

SEQ ID NO: 2008 - DNA, 26 bp, Artificial Sequence
  Description of Artificial Sequence: Synthetic oligonucleotide
  modified_base (5)..(5): Inosine
gtaangtatattattgtcggttataa

SEQ ID NO: 2009 - DNA, 28 bp, Artificial Sequence
  Description of Artificial Sequence: Synthetic oligonucleotide
  modified_base (5)..(5): Inosine
gtaangtatattattgttggttataata

SEQ ID NO: 2010 - DNA, 22 bp, Artificial Sequence
  Description of Artificial Sequence: Synthetic oligonucleotide
gaaagggtgaggaggaattttt

SEQ ID NO: 2011 - DNA, 26 bp, Artificial Sequence
  Description of Artificial Sequence: Synthetic oligonucleotide
aaaaaccaaaaataactccaaacatt

SEQ ID NO: 2012 - DNA, 26 bp, Artificial Sequence
  Description of Artificial Sequence: Synthetic oligonucleotide
tttatttttaggtcgagtgattagtt

SEQ ID NO: 2013 - DNA, 28 bp, Artificial Sequence
  Description of Artificial Sequence: Synthetic oligonucleotide
aatttatttttaggttgagtgattagtt

SEQ ID NO: 2014 - DNA, 19 bp, Artificial Sequence
  Description of Artificial Sequence: Synthetic oligonucleotide
tagttttgggaagtaaaga

SEQ ID NO: 2015 - DNA, 22 bp, Artificial Sequence
  Description of Artificial Sequence: Synthetic oligonucleotide
ctccaaatcatatacctaacta

SEQ ID NO: 2016 - DNA, 21 bp, Artificial Sequence
  Description of Artificial Sequence: Synthetic oligonucleotide
gggtgatttttcgaatttgtg

SEQ ID NO: 2017 - DNA, 23 bp, Artificial Sequence
  Description of Artificial Sequence: Synthetic oligonucleotide
gggtgattttttgaatttgtgtt

SEQ ID NO: 2018 - DNA, 20 bp, Artificial Sequence
  Description of Artificial Sequence: Synthetic oligonucleotide
aatgggagtgatttatagag

SEQ ID NO: 2019 - DNA, 19 bp, Artificial Sequence
  Description of Artificial Sequence: Synthetic oligonucleotide
aaattataccaccctaacc

SEQ ID NO: 2020 - DNA, 26 bp, Artificial Sequence
  Description of Artificial Sequence: Synthetic oligonucleotide
atttaggtatttcgattttaagagga

SEQ ID NO: 2021 - DNA, 28 bp, Artificial Sequence
  Description of Artificial Sequence: Synthetic oligonucleotide
atttaggtattttgattttaagaggatt

SEQ ID NO: 2022 - DNA, 20 bp, Artificial Sequence
  Description of Artificial Sequence: Synthetic oligonucleotide
tttagttgaaggtagtaagt

SEQ ID NO: 2023 - DNA, 22 bp, Artificial Sequence
  Description of Artificial Sequence: Synthetic oligonucleotide
gacaatcacataaccttataaa

SEQ ID NO: 2024 - DNA, 16 bp, Artificial Sequence
  Description of Artificial Sequence: Synthetic oligonucleotide
gggtggttcgtagggt

SEQ ID NO: 2025 - DNA, 18 bp, Artificial Sequence
  Description of Artificial Sequence: Synthetic oligonucleotide
gtgggtggtttgtagggt

SEQ ID NO: 2026 - DNA, 20 bp, Artificial Sequence
  Description of Artificial Sequence: Synthetic oligonucleotide
taggtatggtgaaaatatgt

SEQ ID NO: 2027 - DNA, 20 bp, Artificial Sequence
  Description of Artificial Sequence: Synthetic oligonucleotide
tcaatctaactcaactaaac

SEQ ID NO: 2028 - DNA, 26 bp, Artificial Sequence
  Description of Artificial Sequence: Synthetic oligonucleotide
ttgatatatcgttatatttgagaggg

SEQ ID NO: 2029 - DNA, 28 bp, Artificial Sequence
  Description of Artificial Sequence: Synthetic oligonucleotide
ttttgatatattgttatatttgagaggg

SEQ ID NO: 2030 - DNA, 21 bp, Artificial Sequence
  Description of Artificial Sequence: Synthetic oligonucleotide
  modified_base (15)..(15): Inosine
tgagtttaagtttangtttac

SEQ ID NO: 2031 - DNA, 19 bp, Artificial Sequence
  Description of Artificial Sequence: Synthetic oligonucleotide
tcatttctccctaacaatc

SEQ ID NO: 2032 - DNA, 18 bp, Artificial Sequence
  Description of Artificial Sequence: Synthetic oligonucleotide
  modified_base (4)..(4): Inosine
ggtngagtttcgaggttt

SEQ ID NO: 2033 - DNA, 19 bp, Artificial Sequence
  Description of Artificial Sequence: Synthetic oligonucleotide
  modified_base (5)..(5): Inosine
aggtngagttttgaggttt

SEQ ID NO: 2034 - DNA, 17 bp, Artificial Sequence
  Description of Artificial Sequence: Synthetic oligonucleotide
  modified_base (4)..(4): Inosine
cggngaaaagttgttgt

SEQ ID NO: 2035 - DNA, 19 bp, Artificial Sequence
  Description of Artificial Sequence: Synthetic oligonucleotide
accctactactcaccacta

SEQ ID NO: 2036 - DNA, 22 bp, Artificial Sequence
  Description of Artificial Sequence: Synthetic oligonucleotide
tgtatttagtcggggtagttgt

SEQ ID NO: 2037 - DNA, 24 bp, Artificial Sequence
  Description of Artificial Sequence: Synthetic oligonucleotide
ttgtatttagttggggtagttgtt

SEQ ID NO: 2038 - DNA, 30 bp, Artificial Sequence
  Description of Artificial Sequence: Synthetic oligonucleotide
tatatttatggtgttagttgtatttagaag

SEQ ID NO: 2039 - DNA, 20 bp, Artificial Sequence
  Description of Artificial Sequence: Synthetic oligonucleotide
attaactacgccacctactc

SEQ ID NO: 2040 - DNA, 26 bp, Artificial Sequence
  Description of Artificial Sequence: Synthetic oligonucleotide
ttggtgatagcgtttatatttaattt

SEQ ID NO: 2041 - DNA, 28 bp, Artificial Sequence
  Description of Artificial Sequence: Synthetic oligonucleotide
ttggtgatagtgtttatatttaattttt

SEQ ID NO: 2042 - DNA, 22 bp, Artificial Sequence
  Description of Artificial Sequence: Synthetic oligonucleotide
gtttgttttggaggtaggaagt

SEQ ID NO: 2043 - DNA, 26 bp, Artificial Sequence
  Description of Artificial Sequence: Synthetic oligonucleotide
tttaaattcttaccaaatacatattt

SEQ ID NO: 2044 - DNA, 20 bp, Artificial Sequence
  Description of Artificial Sequence: Synthetic oligonucleotide
  modified_base (5)..(5): Inosine
aggtngtttttcggtgttag

SEQ ID NO: 2045 - DNA, 22 bp, Artificial Sequence
  Description of Artificial Sequence: Synthetic oligonucleotide
  modified_base (6)..(6): Inosine
taggtngttttttggtgttaga

SEQ ID NO: 2046 - DNA, 25 bp, Artificial Sequence
  Description of Artificial Sequence: Synthetic oligonucleotide
aaattacggaggttgttaaatatta

SEQ ID NO: 2047 - DNA, 29 bp, Artificial Sequence
  Description of Artificial Sequence: Synthetic oligonucleotide
tctaacctatataactataaaatctactc

SEQ ID NO: 2048 - DNA, 26 bp, Artificial Sequence
  Description of Artificial Sequence: Synthetic oligonucleotide
ggaggttttagaacgttttagaattg

SEQ ID NO: 2049 - DNA, 27 bp, Artificial Sequence
  Description of Artificial Sequence: Synthetic oligonucleotide
tggaggttttagaatgttttagaattg

SEQ ID NO: 2050 - DNA, 24 bp, Artificial Sequence
  Description of Artificial Sequence: Synthetic oligonucleotide
aagtagttaaagtgtttaagttag

SEQ ID NO: 2051 - DNA, 20 bp, Artificial Sequence
  Description of Artificial Sequence: Synthetic oligonucleotide
tcccaacatacaacataata

SEQ ID NO: 2052 - DNA, 26 bp, Artificial Sequence
  Description of Artificial Sequence: Synthetic oligonucleotide
ttttgagatcggttgttttattagtt

SEQ ID NO: 2053 - DNA, 27 bp, Artificial Sequence
  Description of Artificial Sequence: Synthetic oligonucleotide
ttttgagattggttgttttattagttg

SEQ ID NO: 2054 - DNA, 21 bp, Artificial Sequence
  Description of Artificial Sequence: Synthetic oligonucleotide
tgattttaggaaaggtttaga

SEQ ID NO: 2055 - DNA, 21 bp, Artificial Sequence
  Description of Artificial Sequence: Synthetic oligonucleotide
taccaaaccaacaaaatacaa

SEQ ID NO: 2056 - DNA, 22 bp, Artificial Sequence
  Description of Artificial Sequence: Synthetic oligonucleotide
atagggttgtcgtgagaatagt

SEQ ID NO: 2057 - DNA, 24 bp, Artificial Sequence
  Description of Artificial Sequence: Synthetic oligonucleotide
gatagggttgttgtgagaatagtg

SEQ ID NO: 2058 - DNA, 19 bp, Artificial Sequence
  Description of Artificial Sequence: Synthetic oligonucleotide
tcgatttaaagggatagtc

SEQ ID NO: 2059 - DNA, 19 bp, Artificial Sequence
  Description of Artificial Sequence: Synthetic oligonucleotide
aaacccaaatcttccctac

SEQ ID NO: 2060 - DNA, 27 bp, Artificial Sequence
  Description of Artificial Sequence: Synthetic oligonucleotide
agggagatagtattcgttttatttttg

SEQ ID NO: 2061 - DNA, 28 bp, Artificial Sequence
  Description of Artificial Sequence: Synthetic oligonucleotide
agggagatagtatttgttttatttttgt

SEQ ID NO: 2062 - DNA, 24 bp, Artificial Sequence
  Description of Artificial Sequence: Synthetic oligonucleotide
aggaggtttttatagttttatggt

SEQ ID NO: 2063 - DNA, 22 bp, Artificial Sequence
  Description of Artificial Sequence: Synthetic oligonucleotide
aaaaactcccctccaataaaaa

SEQ ID NO: 2064 - DNA, 13 bp, Artificial Sequence
  Description of Artificial Sequence: Synthetic oligonucleotide
  modified_base (10)..(10): Inosine
agggtcgggnggt

SEQ ID NO: 2065 - DNA, 14 bp, Artificial Sequence
  Description of Artificial Sequence: Synthetic oligonucleotide
  modified_base (10)..(10): Inosine
agggttgggnggtg

SEQ ID NO: 2066 - DNA, 19 bp, Artificial Sequence
  Description of Artificial Sequence: Synthetic oligonucleotide
gggttttgtttaggtgttt

SEQ ID NO: 2067 - DNA, 18 bp, Artificial Sequence
  Description of Artificial Sequence: Synthetic oligonucleotide
taaccaatcctccctttc

SEQ ID NO: 2068 - DNA, 16 bp, Artificial Sequence
  Description of Artificial Sequence: Synthetic oligonucleotide
  modified_base (11)..(11): Inosine
taatgtggcgngtggg

SEQ ID NO: 2069 - DNA, 18 bp, Artificial Sequence
  Description of Artificial Sequence: Synthetic oligonucleotide
  modified_base (12)..(12): Inosine
ttaatgtggtgngtgggt

SEQ ID NO: 2070 - DNA, 25 bp, Artificial Sequence
  Description of Artificial Sequence: Synthetic oligonucleotide
gaaattatttgtgagattaggatag

SEQ ID NO: 2071 - DNA, 21 bp, Artificial Sequence
  Description of Artificial Sequence: Synthetic oligonucleotide
  modified_base (4)..(4): Inosine
aaangacacaataaccacttc

SEQ ID NO: 2072 - DNA, 26 bp, Artificial Sequence
  Description of Artificial Sequence: Synthetic oligonucleotide
ttttcgatgtttttagaatttgtagt

SEQ ID NO: 2073 - DNA, 28 bp, Artificial Sequence
  Description of Artificial Sequence: Synthetic oligonucleotide
tttttttgatgtttttagaatttgtagt

SEQ ID NO: 2074 - DNA, 19 bp, Artificial Sequence
  Description of Artificial Sequence: Synthetic oligonucleotide
gggatttggaggaggtttt

SEQ ID NO: 2075 - DNA, 26 bp, Artificial Sequence
  Description of Artificial Sequence: Synthetic oligonucleotide
cctcacatcttatttatcatatctac

SEQ ID NO: 2076 - DNA, 24 bp, Artificial Sequence
  Description of Artificial Sequence: Synthetic oligonucleotide
gtttttcggggttattaggtattg

SEQ ID NO: 2077 - DNA, 25 bp, Artificial Sequence
  Description of Artificial Sequence: Synthetic oligonucleotide
gttttttggggttattaggtattga

SEQ ID NO: 2078 - DNA, 17 bp, Artificial Sequence
  Description of Artificial Sequence: Synthetic oligonucleotide
  modified_base (4)..(4): Inosine
attnggagtgggaagtg

SEQ ID NO: 2079 - DNA, 20 bp, Artificial Sequence
  Description of Artificial Sequence: Synthetic oligonucleotide
gtaccaatacaacaactaac

SEQ ID NO: 2080 - DNA, 16 bp, Artificial Sequence
  Description of Artificial Sequence: Synthetic oligonucleotide
  modified_base (6)..(6): Inosine
gtttgngagtcggggt

SEQ ID NO: 2081 - DNA, 17 bp, Artificial Sequence
  Description of Artificial Sequence: Synthetic oligonucleotide
  modified_base (7)..(7): Inosine
ggtttgngagttggggt

SEQ ID NO: 2082 - DNA, 22 bp, Artificial Sequence
  Description of Artificial Sequence: Synthetic oligonucleotide
tgtatgggtggagtatttatag

SEQ ID NO: 2083 - DNA, 24 bp, Artificial Sequence
  Description of Artificial Sequence: Synthetic oligonucleotide
cttcaaaaccaaccttaataaaac

SEQ ID NO: 2084 - DNA, 30 bp, Artificial Sequence
  Description of Artificial Sequence: Synthetic oligonucleotide
atttttattcgtttgttttatgatagagat

SEQ ID NO: 2085 - DNA, 33 bp, Artificial Sequence
  Description of Artificial Sequence: Synthetic oligonucleotide
tttatttttatttgtttgttttatgatagagat

SEQ ID NO: 2086 - DNA, 24 bp, Artificial Sequence
  Description of Artificial Sequence: Synthetic oligonucleotide
ttatagggattattatatgggtaa

SEQ ID NO: 2087 - DNA, 22 bp, Artificial Sequence
  Description of Artificial Sequence: Synthetic oligonucleotide
acctaacaataatcacttaaaa

SEQ ID NO: 2088 - DNA, 16 bp, Artificial Sequence
  Description of Artificial Sequence: Synthetic oligonucleotide
  modified_base (4)..(4): Inosine
  modified_base (6)..(6): Inosine
gttngngtcgagggat

SEQ ID NO: 2089 - DNA, 17 bp, Artificial Sequence
  Description of Artificial Sequence: Synthetic oligonucleotide
  modified_base (5)..(5): Inosine
  modified_base (7)..(7): Inosine
tgttngngttgagggat

SEQ ID NO: 2090 - DNA, 15 bp, Artificial Sequence
  Description of Artificial Sequence: Synthetic oligonucleotide
  modified_base (6)..(6): Inosine
aagagngaggtgttg

SEQ ID NO: 2091 - DNA, 21 bp, Artificial Sequence
  Description of Artificial Sequence: Synthetic oligonucleotide
  modified_base (2)..(2): Inosine
angctacaaactaatatacaa

SEQ ID NO: 2092 - DNA, 19 bp, Artificial Sequence
  Description of Artificial Sequence: Synthetic oligonucleotide
  modified_base (14)..(14): Inosine
  modified_base (16)..(16): Inosine
ggttagtttatcgngngtt

SEQ ID NO: 2093 - DNA, 20 bp, Artificial Sequence
  Description of Artificial Sequence: Synthetic oligonucleotide
  modified_base (15)..(15): Inosine
  modified_base (17)..(17): Inosine
aggttagtttattgngngtt

SEQ ID NO: 2094 - DNA, 20 bp, Artificial Sequence
  Description of Artificial Sequence: Synthetic oligonucleotide
gttggtgttggtttagttat

SEQ ID NO: 2095 - DNA, 23 bp, Artificial Sequence
  Description of Artificial Sequence: Synthetic oligonucleotide
gatctctaaaacctaatacaaat

SEQ ID NO: 2096 - DNA, 21 bp, Artificial Sequence
  Description of Artificial Sequence: Synthetic oligonucleotide
  modified_base (11)..(11): Inosine
tttagatggangcgtttgttt

SEQ ID NO: 2097 - DNA, 23 bp, Artificial Sequence
  Description of Artificial Sequence: Synthetic oligonucleotide
  modified_base (13)..(13): Inosine
ggtttagatggangtgtttgttt

SEQ ID NO: 2098 - DNA, 15 bp, Artificial Sequence
  Description of Artificial Sequence: Synthetic oligonucleotide
gggttgggggttttt

SEQ ID NO: 2099 - DNA, 19 bp, Artificial Sequence
  Description of Artificial Sequence: Synthetic oligonucleotide
aaaccccaaatattccaaa

SEQ ID NO: 2100 - DNA, 19 bp, Artificial Sequence
  Description of Artificial Sequence: Synthetic oligonucleotide
  modified_base (12)..(12): Inosine
ttgttggcgttngtttagg

SEQ ID NO: 2101 - DNA, 20 bp, Artificial Sequence
  Description of Artificial Sequence: Synthetic oligonucleotide
ttgttggtgtttgtttaggg

SEQ ID NO: 2102 - DNA, 17 bp, Artificial Sequence
  Description of Artificial Sequence: Synthetic oligonucleotide
gtttgagggggaatagg

SEQ ID NO: 2103 - DNA, 17 bp, Artificial Sequence
  Description of Artificial Sequence: Synthetic oligonucleotide
  modified_base (5)..(5): Inosine
  modified_base (10)..(10): Inosine
atacngaaangaatcac

SEQ ID NO: 2104 - DNA, 21 bp, Artificial Sequence
  Description of Artificial Sequence: Synthetic oligonucleotide
  modified_base (2)..(2): Inosine
  modified_base (18)..(18): Inosine
tngttttttcgttttttnggg

SEQ ID NO: 2105 - DNA, 22 bp, Artificial Sequence
  Description of Artificial Sequence: Synthetic oligonucleotide
  modified_base (2)..(2): Inosine
  modified_base (18)..(18): Inosine
tngtttttttgttttttngggt

SEQ ID NO: 2106 - DNA, 19 bp, Artificial Sequence
  Description of Artificial Sequence: Synthetic oligonucleotide
  modified_base (12)..(12): Inosine
ttttgaggattnggtaaga

SEQ ID NO: 2107 - DNA, 25 bp, Artificial Sequence
  Description of Artificial Sequence: Synthetic oligonucleotide
  modified_base (5)..(5): Inosine
gaaangatcaaaaattaaataaaac

SEQ ID NO: 2108 - DNA, 19 bp, Artificial Sequence
  Description of Artificial Sequence: Synthetic oligonucleotide
ggtgagtgttgcgatttgg

SEQ ID NO: 2109 - DNA, 20 bp, Artificial Sequence
  Description of Artificial Sequence: Synthetic oligonucleotide
tggtgagtgttgtgatttgg

SEQ ID NO: 2110 - DNA, 23 bp, Artificial Sequence
  Description of Artificial Sequence: Synthetic oligonucleotide
tagtattgagattattggttttt

SEQ ID NO: 2111 - DNA, 25 bp, Artificial Sequence
  Description of Artificial Sequence: Synthetic oligonucleotide
caactataattcctctaattctaaa

SEQ ID NO: 2112 - DNA, 23 bp, Artificial Sequence
  Description of Artificial Sequence: Synthetic oligonucleotide
  modified_base (19)..(19): Inosine
  modified_base (21)..(21): Inosine
gaattatgaaaatcggtangnga

SEQ ID NO: 2113 - DNA, 24 bp, Artificial Sequence
  Description of Artificial Sequence: Synthetic oligonucleotide
  modified_base (20)..(20): Inosine
  modified_base (22)..(22): Inosine
ggaattatgaaaattggtangnga

SEQ ID NO: 2114 - DNA, 25 bp, Artificial Sequence
  Description of Artificial Sequence: Synthetic oligonucleotide
tttttagaaattgggtatttttaag

SEQ ID NO: 2115 - DNA, 28 bp, Artificial Sequence
  Description of Artificial Sequence: Synthetic oligonucleotide
  modified_base (2)..(2): Inosine
cngctataaactattaaatctaaataca

SEQ ID NO: 2116 - DNA, 32 bp, Artificial Sequence
  Description of Artificial Sequence: Synthetic oligonucleotide
gttttattattcgttttttttttttttttttt

SEQ ID NO: 2117 - DNA, 34 bp, Artificial Sequence
  Description of Artificial Sequence: Synthetic oligonucleotide
agttttattatttgtttttttttttttttttttt

SEQ ID NO: 2118 - DNA, 19 bp, Artificial Sequence
  Description of Artificial Sequence: Synthetic oligonucleotide
  modified_base (2)..(2): Inosine
gnggtagggtatattagag

SEQ ID NO: 2119 - DNA, 19 bp, Artificial Sequence
  Description of Artificial Sequence: Synthetic oligonucleotide
gctccccaaacttaaatcc

SEQ ID NO: 2120 - DNA, 17 bp, Artificial Sequence
  Description of Artificial Sequence: Synthetic oligonucleotide
  modified_base (3)..(3): Inosine
  modified_base (13)..(13): Inosine
ttngggattcgtnggtt

SEQ ID NO: 2121 - DNA, 20 bp, Artificial Sequence
  Description of Artificial Sequence: Synthetic oligonucleotide
  modified_base (6)..(6): Inosine
  modified_base (16)..(16): Inosine
tttttngggatttgtnggtt

SEQ ID NO: 2122 - DNA, 19 bp, Artificial Sequence
  Description of Artificial Sequence: Synthetic oligonucleotide
  modified_base (10)..(10): Inosine
ggatatagtngttgtgttt

SEQ ID NO: 2123 - DNA, 22 bp, Artificial Sequence
  Description of Artificial Sequence: Synthetic oligonucleotide
ccataaaatccaacaaaaataa

SEQ ID NO: 2124 - DNA, 22 bp, Artificial Sequence
  Description of Artificial Sequence: Synthetic oligonucleotide
tttgagggcgatgttgatatag

SEQ ID NO: 2125 - DNA, 25 bp, Artificial Sequence
  Description of Artificial Sequence: Synthetic oligonucleotide
ggttttgagggtgatgttgatatag

SEQ ID NO: 2126 - DNA, 23 bp, Artificial Sequence
  Description of Artificial Sequence: Synthetic oligonucleotide
agagaagaaagtaagtagttaat

SEQ ID NO: 2127 - DNA, 24 bp, Artificial Sequence
  Description of Artificial Sequence: Synthetic oligonucleotide
ttcctcttaaaaataaacaatcat

SEQ ID NO: 2128 - DNA, 21 bp, Artificial Sequence
  Description of Artificial Sequence: Synthetic oligonucleotide
  modified_base (15)..(15): Inosine
gaaaaagttagcgtnggaagt

SEQ ID NO: 2129 - DNA, 23 bp, Artificial Sequence
  Description of Artificial Sequence: Synthetic oligonucleotide
  modified_base (17)..(17): Inosine
ttgaaaaagttagtgtnggaagt

SEQ ID NO: 2130 - DNA, 19 bp, Artificial Sequence
  Description of Artificial Sequence: Synthetic oligonucleotide
gttaggagttggagattag

SEQ ID NO: 2131 - DNA, 19 bp, Artificial Sequence
  Description of Artificial Sequence: Synthetic oligonucleotide
ttctcctacctcaacttac

SEQ ID NO: 2132 - DNA, 16 bp, Artificial Sequence
  Description of Artificial Sequence: Synthetic oligonucleotide
  modified_base (4)..(4): Inosine
tggnggtgcgtttttg

SEQ ID NO: 2133 - DNA, 19 bp, Artificial Sequence
  Description of Artificial Sequence: Synthetic oligonucleotide
  modified_base (4)..(4): Inosine
tggnggtgtgtttttgtaa

SEQ ID NO: 2134 - DNA, 25 bp, Artificial Sequence
  Description of Artificial Sequence: Synthetic oligonucleotide
taagtaaatagttggtatttttaga

SEQ ID NO: 2135 - DNA, 23 bp, Artificial Sequence
  Description of Artificial Sequence: Synthetic oligonucleotide
  modified_base (2)..(2): Inosine
tngaaaaaactaattacaactta

SEQ ID NO: 2136 - DNA, 24 bp, Artificial Sequence
  Description of Artificial Sequence: Synthetic oligonucleotide
atagagaagatcgggtttagtagg

SEQ ID NO: 2137 - DNA, 25 bp, Artificial Sequence
  Description of Artificial Sequence: Synthetic oligonucleotide
gatagagaagattgggtttagtagg

SEQ ID NO: 2138 - DNA, 19 bp, Artificial Sequence
  Description of Artificial Sequence: Synthetic oligonucleotide
gtgagtagttgggatttgg

SEQ ID NO: 2139 - DNA, 21 bp, Artificial Sequence
  Description of Artificial Sequence: Synthetic oligonucleotide
  modified_base (8)..(8): Inosine
aacattangaactccatattc

SEQ ID NO: 2140 - DNA, 29 bp, Artificial Sequence
  Description of Artificial Sequence: Synthetic oligonucleotide
  modified_base (18)..(18): Inosine
tgtttttttttattcgtngttatttatgg

SEQ ID NO: 2141 - DNA, 30 bp, Artificial Sequence
  Description of Artificial Sequence: Synthetic oligonucleotide
  modified_base (18)..(18): Inosine
tgtttttttttatttgtngttatttatggt

SEQ ID NO: 2142 - DNA, 21 bp, Artificial Sequence
  Description of Artificial Sequence: Synthetic oligonucleotide
tggtgggattttagttttagg

SEQ ID NO: 2143 - DNA, 27 bp, Artificial Sequence
  Description of Artificial Sequence: Synthetic oligonucleotide
aaactataaacaactcaactaattatc

SEQ ID NO: 2144 - DNA, 24 bp, Artificial Sequence
  Description of Artificial Sequence: Synthetic oligonucleotide
gtgtagtattcggtttttaggtgg

SEQ ID NO: 2145 - DNA, 25 bp, Artificial Sequence
  Description of Artificial Sequence: Synthetic oligonucleotide
ggtgtagtatttggtttttaggtgg

SEQ ID NO: 2146 - DNA, 23 bp, Artificial Sequence
  Description of Artificial Sequence: Synthetic oligonucleotide
ggaaagaaagggatttttatagg

SEQ ID NO: 2147 - DNA, 19 bp, Artificial Sequence
  Description of Artificial Sequence: Synthetic oligonucleotide
cccttttccatactctatc

SEQ ID NO: 2148 - DNA, 23 bp, Artificial Sequence
  Description of Artificial Sequence: Synthetic oligonucleotide
aaattaagggcgagggattaaag

SEQ ID NO: 2149 - DNA, 27 bp, Artificial Sequence
  Description of Artificial Sequence: Synthetic oligonucleotide
gataaattaagggtgagggattaaaga

SEQ ID NO: 2150 - DNA, 21 bp, Artificial Sequence
  Description of Artificial Sequence: Synthetic oligonucleotide
gggatagaattggaattagtg

SEQ ID NO: 2151 - DNA, 15 bp, Artificial Sequence
  Description of Artificial Sequence: Synthetic oligonucleotide
cccacccacccaatc

SEQ ID NO: 2152 - DNA, 16 bp, Artificial Sequence
  Description of Artificial Sequence: Synthetic oligonucleotide
  modified_base (14)..(14): Inosine
ggaagtgcgtttgngt

SEQ ID NO: 2153 - DNA, 19 bp, Artificial Sequence
  Description of Artificial Sequence: Synthetic oligonucleotide
  modified_base (15)..(15): Inosine
gggaagtgtgtttgngtaa

SEQ ID NO: 2154 - DNA, 24 bp, Artificial Sequence
  Description of Artificial Sequence: Synthetic oligonucleotide
  modified_base (8)..(8): Inosine
gagtttanggtatttattaaatag

SEQ ID NO: 2155 - DNA, 22 bp, Artificial Sequence
  Description of Artificial Sequence: Synthetic oligonucleotide
gactacaaaccaaaataaaaaa

SEQ ID NO: 2156 - DNA, 20 bp, Artificial Sequence
  Description of Artificial Sequence: Synthetic oligonucleotide
agaagtgagcgtattgtggt

SEQ ID NO: 2157 - DNA, 22 bp, Artificial Sequence
  Description of Artificial Sequence: Synthetic oligonucleotide
tgagaagtgagtgtattgtggt

SEQ ID NO: 2158 - DNA, 16 bp, Artificial Sequence
  Description of Artificial Sequence: Synthetic oligonucleotide
ggtggttatggggttt

SEQ ID NO: 2159 - DNA, 24 bp, Artificial Sequence
  Description of Artificial Sequence: Synthetic oligonucleotide
  modified_base (9)..(9): Inosine
aaccctaangaaaaaataaatacc

SEQ ID NO: 2160 - DNA, 28 bp, Artificial Sequence
  Description of Artificial Sequence: Synthetic oligonucleotide
tttttatttatgttttcgttagggtttt

SEQ ID NO: 2161 - DNA, 31 bp, Artificial Sequence
  Description of Artificial Sequence: Synthetic oligonucleotide
ttatttttatttatgtttttgttagggtttt

SEQ ID NO: 2162 - DNA, 18 bp, Artificial Sequence
  Description of Artificial Sequence: Synthetic oligonucleotide
gagtttggggttaggata

SEQ ID NO: 2163 - DNA, 15 bp, Artificial Sequence
  Description of Artificial Sequence: Synthetic oligonucleotide
  modified_base (2)..(2): Inosine
  modified_base (6)..(6): Inosine
tngccngctctaaaa

SEQ ID NO: 2164 - DNA, 15 bp, Artificial Sequence
  Description of Artificial Sequence: Synthetic oligonucleotide
  modified_base (6)..(6): Inosine
ggggtngcggtgttt

SEQ ID NO: 2165 - DNA, 18 bp, Artificial Sequence
  Description of Artificial Sequence: Synthetic oligonucleotide
  modified_base (7)..(7): Inosine
tggggtngtggtgttttt

SEQ ID NO: 2166 - DNA, 20 bp, Artificial Sequence
  Description of Artificial Sequence: Synthetic oligonucleotide
gtttttagggttggtggtag

SEQ ID NO: 2167 - DNA, 23 bp, Artificial Sequence
  Description of Artificial Sequence: Synthetic oligonucleotide
  modified_base (2)..(2): Inosine
gngtcctcataataataaataac

SEQ ID NO: 2168 - DNA, 20 bp, Artificial Sequence
  Description of Artificial Sequence: Synthetic oligonucleotide
  modified_base (14)..(14): Inosine
gggttttcgttagngaagat

SEQ ID NO: 2169 - DNA, 21 bp, Artificial Sequence
  Description of Artificial Sequence: Synthetic oligonucleotide
  modified_base (15)..(15): Inosine
ggggtttttgttagngaagat

SEQ ID NO: 2170 - DNA, 18 bp, Artificial Sequence
  Description of Artificial Sequence: Synthetic oligonucleotide
  modified_base (10)..(10): Inosine
atgttgagtngtagagat

SEQ ID NO: 2171 - DNA, 17 bp, Artificial Sequence
  Description of Artificial Sequence: Synthetic oligonucleotide
  modified_base (5)..(5): Inosine
  modified_base (8)..(8): Inosine
caaangangaaaaacaa

SEQ ID NO: 2172 - DNA, 18 bp, Artificial Sequence
  Description of Artificial Sequence: Synthetic oligonucleotide
  modified_base (4)..(4): Inosine
  modified_base (13)..(13): Inosine
gttngaaggcgtngtttt

SEQ ID NO: 2173 - DNA, 20 bp, Artificial Sequence
  Description of Artificial Sequence: Synthetic oligonucleotide
  modified_base (6)..(6): Inosine
  modified_base (15)..(15): Inosine
ttgttngaaggtgtngtttt

SEQ ID NO: 2174 - DNA, 19 bp, Artificial Sequence
  Description of Artificial Sequence: Synthetic oligonucleotide
  modified_base (8)..(8): Inosine
gtagaatngggttttagga

SEQ ID NO: 2175 - DNA, 19 bp, Artificial Sequence
  Description of Artificial Sequence: Synthetic oligonucleotide
  modified_base (2)..(2): Inosine
  modified_base (7)..(7): Inosine
angaaangttatccatctc

SEQ ID NO: 2176 - DNA, 18 bp, Artificial Sequence
  Description of Artificial Sequence: Synthetic oligonucleotide
  modified_base (3)..(3): Inosine
  modified_base (14)..(14): Inosine
gangttaggtcgtnggtt

SEQ ID NO: 2177 - DNA, 19 bp, Artificial Sequence
  Description of Artificial Sequence: Synthetic oligonucleotide
  modified_base (4)..(4): Inosine
  modified_base (15)..(15): Inosine
ggangttaggttgtnggtt

SEQ ID NO: 2178 - DNA, 17 bp, Artificial Sequence
  Description of Artificial Sequence: Synthetic oligonucleotide
  modified_base (5)..(5): Inosine
gtttngggaaatttgtg

SEQ ID NO: 2179 - DNA, 20 bp, Artificial Sequence
  Description of Artificial Sequence: Synthetic oligonucleotide
aaatcccaaaccaaataaac

SEQ ID NO: 2180 - DNA, 18 bp, Artificial Sequence
  Description of Artificial Sequence: Synthetic oligonucleotide
  modified_base (11)..(11): Inosine
tttgtgtgcgngaaagtt

SEQ ID NO: 2181 - DNA, 23 bp, Artificial Sequence
  Description of Artificial Sequence: Synthetic oligonucleotide
  modified_base (14)..(14): Inosine
gaatttgtgtgtgngaaagttta

SEQ ID NO: 2182 - DNA, 16 bp, Artificial Sequence
  Description of Artificial Sequence: Synthetic oligonucleotide
  modified_base (4)..(4): Inosine
  modified_base (11)..(11): Inosine
gtgngggtttngaatt

SEQ ID NO: 2183 - DNA, 20 bp, Artificial Sequence
  Description of Artificial Sequence: Synthetic oligonucleotide
  modified_base (3)..(3): Inosine
  modified_base (11)..(11): Inosine
gangaaaaacngacataaac

SEQ ID NO: 2184 - DNA, 16 bp, Artificial Sequence
  Description of Artificial Sequence: Synthetic oligonucleotide
  modified_base (8)..(8): Inosine
ggtagcgngggaatgt

SEQ ID NO: 2185 - DNA, 19 bp, Artificial Sequence
  Description of Artificial Sequence: Synthetic oligonucleotide
  modified_base (8)..(8): Inosine
ggtagtgngggaatgtttt

SEQ ID NO: 2186 - DNA, 19 bp, Artificial Sequence
  Description of Artificial Sequence: Synthetic oligonucleotide
taggaaggtgtaggtagag

SEQ ID NO: 2187 - DNA, 19 bp, Artificial Sequence
  Description of Artificial Sequence: Synthetic oligonucleotide
caccactaaacctcctatc

SEQ ID NO: 2188 - DNA, 17 bp, Artificial Sequence
  Description of Artificial Sequence: Synthetic oligonucleotide
  modified_base (6)..(6): Inosine
  modified_base (12)..(12): Inosine
tggtanggcgtngttag

SEQ ID NO: 2189 - DNA, 18 bp, Artificial Sequence
  Description of Artificial Sequence: Synthetic oligonucleotide
  modified_base (6)..(6): Inosine
  modified_base (12)..(12): Inosine
tggtanggtgtngttagg

SEQ ID NO: 2190 - DNA, 21 bp, Artificial Sequence
  Description of Artificial Sequence: Synthetic oligonucleotide
tggttgttttttaggtatttg

SEQ ID NO: 2191 - DNA, 17 bp, Artificial Sequence
  Description of Artificial Sequence: Synthetic oligonucleotide
  modified_base (7)..(7): Inosine
caacctngctctaatcc

SEQ ID NO: 2192 - DNA, 21 bp, Artificial Sequence
  Description of Artificial Sequence: Synthetic oligonucleotide
  modified_base (3)..(3): Inosine
ggnggtcgtttttttttttgt

SEQ ID NO: 2193 - DNA, 24 bp, Artificial Sequence
  Description of Artificial Sequence: Synthetic oligonucleotide
  modified_base (3)..(3): Inosine
ggnggttgtttttttttttgttta

SEQ ID NO: 2194 - DNA, 20 bp, Artificial Sequence
  Description of Artificial Sequence: Synthetic oligonucleotide
gtaggaaggtgtaggtagag

SEQ ID NO: 2195 - DNA, 18 bp, Artificial Sequence
  Description of Artificial Sequence: Synthetic oligonucleotide
ccactaaacctcctatcc

SEQ ID NO: 2196 - DNA, 22 bp, Artificial Sequence
  Description of Artificial Sequence: Synthetic oligonucleotide
gaaaattgtggcgttttaaggg

SEQ ID NO: 2197 - DNA, 23 bp, Artificial Sequence
  Description of Artificial Sequence: Synthetic oligonucleotide
ggaaaattgtggtgttttaaggg

SEQ ID NO: 2198 - DNA, 24 bp, Artificial Sequence
  Description of Artificial Sequence: Synthetic oligonucleotide
  modified_base (6)..(6): Inosine
ggtagngtttatggttatttatta

SEQ ID NO: 2199 - DNA, 23 bp, Artificial Sequence
  Description of Artificial Sequence: Synthetic oligonucleotide
  modified_base (12)..(12): Inosine
caaaaactatcngaaaaataaca

SEQ ID NO: 2200 - DNA, 18 bp, Artificial Sequence
  Description of Artificial Sequence: Synthetic oligonucleotide
  modified_base (2)..(2): Inosine
  modified_base (14)..(14): Inosine
tngttgagtcggangatt

SEQ ID NO: 2201 - DNA, 20 bp, Artificial Sequence
  Description of Artificial Sequence: Synthetic oligonucleotide
  modified_base (2)..(2): Inosine
  modified_base (14)..(14): Inosine
tngttgagttggangattgt

SEQ ID NO: 2202 - DNA, 17 bp, Artificial Sequence
  Description of Artificial Sequence: Synthetic oligonucleotide
  modified_base (10)..(10): Inosine
gaaggtgagngttagaa

SEQ ID NO: 2203 - DNA, 17 bp, Artificial Sequence
  Description of Artificial Sequence: Synthetic oligonucleotide
  modified_base (6)..(6): Inosine
gaaatngcctacaaaac

SEQ ID NO: 2204 - DNA, 15 bp, Artificial Sequence
  Description of Artificial Sequence: Synthetic oligonucleotide
  modified_base (11)..(11): Inosine
agggttggcgnggtt

SEQ ID NO: 2205 - DNA, 17 bp, Artificial Sequence
  Description of Artificial Sequence: Synthetic oligonucleotide
  modified_base (13)..(13): Inosine
ggagggttggtgnggtt

SEQ ID NO: 2206 - DNA, 21 bp, Artificial Sequence
  Description of Artificial Sequence: Synthetic oligonucleotide
gggaaaaataggatttttgat

SEQ ID NO: 2207 - DNA, 20 bp, Artificial Sequence
  Description of Artificial Sequence: Synthetic oligonucleotide
  modified_base (3)..(3): Inosine
aangctaaaattacaaaaca

SEQ ID NO: 2208 - DNA, 19 bp, Artificial Sequence
  Description of Artificial Sequence: Synthetic oligonucleotide
  modified_base (5)..(5): Inosine
agtgngggtcgtttttaag

SEQ ID NO: 2209 - DNA, 20 bp, Artificial Sequence
  Description of Artificial Sequence: Synthetic oligonucleotide
  modified_base (5)..(5): Inosine
agtgngggttgtttttaagg

SEQ ID NO: 2210 - DNA, 17 bp, Artificial Sequence
  Description of Artificial Sequence: Synthetic oligonucleotide
  modified_base (7)..(7): Inosine
ttttgtngggtttgttt

SEQ ID NO: 2211 - DNA, 27 bp, Artificial Sequence
  Description of Artificial Sequence: Synthetic oligonucleotide
ctcataactaaaatctctaatataatc

SEQ ID NO: 2212 - DNA, 19 bp, Artificial Sequence
  Description of Artificial Sequence: Synthetic oligonucleotide
  modified_base (16)..(16): Inosine
tggataggtcgttgtngtt

SEQ ID NO: 2213 - DNA, 21 bp, Artificial Sequence
  Description of Artificial Sequence: Synthetic oligonucleotide
  modified_base (17)..(17): Inosine
gtggataggttgttgtngttt

SEQ ID NO: 2214 - DNA, 21 bp, Artificial Sequence
  Description of Artificial Sequence: Synthetic oligonucleotide
gaattgtggtgtagttagaag

SEQ ID NO: 2215 - DNA, 21 bp, Artificial Sequence
  Description of Artificial Sequence: Synthetic oligonucleotide
ctcccatctaccttaaaattc

SEQ ID NO: 2216 - DNA, 28 bp, Artificial Sequence
  Description of Artificial Sequence: Synthetic oligonucleotide
aagagttttttcgtaaattatgatttgt

SEQ ID NO: 2217 - DNA, 31 bp, Artificial Sequence
  Description of Artificial Sequence: Synthetic oligonucleotide
tttaagagtttttttgtaaattatgatttgt

SEQ ID NO: 2218 - DNA, 21 bp, Artificial Sequence
  Description of Artificial Sequence: Synthetic oligonucleotide
tttaggatgggtttgaaatag

SEQ ID NO: 2219 - DNA, 23 bp, Artificial Sequence
  Description of Artificial Sequence: Synthetic oligonucleotide
actcaaaactaacaaaaatattc

SEQ ID NO: 2220 - DNA, 15 bp, Artificial Sequence
  Description of Artificial Sequence: Synthetic oligonucleotide
  modified_base (11)..(11): Inosine
ttggggcggtngatg

SEQ ID NO: 2221 - DNA, 17 bp, Artificial Sequence
  Description of Artificial Sequence: Synthetic oligonucleotide
  modified_base (12)..(12): Inosine
gttggggtggtngatga

SEQ ID NO: 2222 - DNA, 18 bp, Artificial Sequence
  Description of Artificial Sequence: Synthetic oligonucleotide
  modified_base (9)..(9): Inosine
ggatagaangtgttagtg

SEQ ID NO: 2223 - DNA, 18 bp, Artificial Sequence
  Description of Artificial Sequence: Synthetic oligonucleotide
  modified_base (3)..(3): Inosine
  modified_base (10)..(10): Inosine
gangataacngaaactac

SEQ ID NO: 2224 - DNA, 28 bp, Artificial Sequence
  Description of Artificial Sequence: Synthetic oligonucleotide
  modified_base (26)..(26): Inosine
attttttattatatcgtagaggaatngt

SEQ ID NO: 2225 - DNA, 31 bp, Artificial Sequence
  Description of Artificial Sequence: Synthetic oligonucleotide
  modified_base (29)..(29): Inosine
tttattttttattatattgtagaggaatngt

SEQ ID NO: 2226 - DNA, 15 bp, Artificial Sequence
  Description of Artificial Sequence: Synthetic oligonucleotide
  modified_base (8)..(8): Inosine
gagtatgnggtgagg

SEQ ID NO: 2227 - DNA, 22 bp, Artificial Sequence
  Description of Artificial Sequence: Synthetic oligonucleotide
ttctaaaatactactccatctc

SEQ ID NO: 2228 - DNA, 25 bp, Artificial Sequence
  Description of Artificial Sequence: Synthetic oligonucleotide
  modified_base (3)..(3): Inosine
  modified_base (23)..(23): Inosine
tangtttatttttcgtgtttatngg

SEQ ID NO: 2229 - DNA, 26 bp, Artificial Sequence
  Description of Artificial Sequence: Synthetic oligonucleotide
  modified_base (3)..(3): Inosine
  modified_base (23)..(23): Inosine
tangtttattttttgtgtttatnggg

SEQ ID NO: 2230 - DNA, 18 bp, Artificial Sequence
  Description of Artificial Sequence: Synthetic oligonucleotide
tgtggggagattattgag

SEQ ID NO: 2231 - DNA, 17 bp, Artificial Sequence
  Description of Artificial Sequence: Synthetic oligonucleotide
  modified_base (4)..(4): Inosine
cctngaacactaaaacc

SEQ ID NO: 2232 - DNA, 27 bp, Artificial Sequence
  Description of Artificial Sequence: Synthetic oligonucleotide
atggatttatttcggatagattaggag

SEQ ID NO: 2233 - DNA, 29 bp, Artificial Sequence
  Description of Artificial Sequence: Synthetic oligonucleotide
tatggatttattttggatagattaggagg

SEQ ID NO: 2234 - DNA, 22 bp, Artificial Sequence
  Description of Artificial Sequence: Synthetic oligonucleotide
ggggtaaggaattaatattgag

SEQ ID NO: 2235 - DNA, 20 bp, Artificial Sequence
  Description of Artificial Sequence: Synthetic oligonucleotide
  modified_base (6)..(6): Inosine
  modified_base (12)..(12): Inosine
cattangaaacngaataaac

SEQ ID NO: 2236 - DNA, 16 bp, Artificial Sequence
  Description of Artificial Sequence: Synthetic oligonucleotide
  modified_base (3)..(3): Inosine
ggngggttcgttgttg

SEQ ID NO: 2237 - DNA, 17 bp, Artificial Sequence
  Description of Artificial Sequence: Synthetic oligonucleotide
  modified_base (3)..(3): Inosine
ggngggtttgttgttgg

SEQ ID NO: 2238 - DNA, 22 bp, Artificial Sequence
  Description of Artificial Sequence: Synthetic oligonucleotide
ttgtaatgagaggtttgttaat

SEQ ID NO: 2239 - DNA, 22 bp, Artificial Sequence
  Description of Artificial Sequence: Synthetic oligonucleotide
  modified_base (9)..(9): Inosine
ctaaatatngcaaaaaactctt

SEQ ID NO: 2240 - DNA, 23 bp, Artificial Sequence
  Description of Artificial Sequence: Synthetic oligonucleotide
  modified_base (15)..(15): Inosine
ttttgtgtaggcgtngatattta

SEQ ID NO: 2241 - DNA, 25 bp, Artificial Sequence
  Description of Artificial Sequence: Synthetic oligonucleotide
  modified_base (15)..(15): Inosine
ttttgtgtaggtgtngatatttagg

SEQ ID NO: 2242 - DNA, 21 bp, Artificial Sequence
  Description of Artificial Sequence: Synthetic oligonucleotide
gtgtttaggatgttagattag

SEQ ID NO: 2243 - DNA, 21 bp, Artificial Sequence
  Description of Artificial Sequence: Synthetic oligonucleotide
tctttactatcttccctattc

SEQ ID NO: 2244 - DNA, 27 bp, Artificial Sequence
  Description of Artificial Sequence: Synthetic oligonucleotide
ttgtagttttgtatttttcgagagaag

SEQ ID NO: 2245 - DNA, 29 bp, Artificial Sequence
  Description of Artificial Sequence: Synthetic oligonucleotide
ttttgtagttttgtattttttgagagaag

SEQ ID NO: 2246 - DNA, 26 bp, Artificial Sequence
  Description of Artificial Sequence: Synthetic oligonucleotide
gtttggtttaaagttagaattaatag

SEQ ID NO: 2247 - DNA, 24 bp, Artificial Sequence
  Description of Artificial Sequence: Synthetic oligonucleotide
caacctctaaattattaaacaatc

SEQ ID NO: 2248 - DNA, 20 bp, Artificial Sequence
  Description of Artificial Sequence: Synthetic oligonucleotide
gttgttagatcggggagagt

SEQ ID NO: 2249 - DNA, 21 bp, Artificial Sequence
  Description of Artificial Sequence: Synthetic oligonucleotide
ggttgttagattggggagagt

SEQ ID NO: 2250 - DNA, 26 bp, Artificial Sequence
  Description of Artificial Sequence: Synthetic oligonucleotide
attgagaaattttaaataggtattat

SEQ ID NO: 2251 - DNA, 29 bp, Artificial Sequence
  Description of Artificial Sequence: Synthetic oligonucleotide
gctctatttatatacttttaatttttcat

SEQ ID NO: 2252 - DNA, 29 bp, Artificial Sequence
  Description of Artificial Sequence: Synthetic oligonucleotide
tggttattttaattacgtagaaatgaatt

SEQ ID NO: 2253 - DNA, 32 bp, Artificial Sequence
  Description of Artificial Sequence: Synthetic oligonucleotide
tttggttattttaattatgtagaaatgaattt

SEQ ID NO: 2254 - DNA, 18 bp, Artificial Sequence
  Description of Artificial Sequence: Synthetic oligonucleotide
ttaggggtgatggtagtg

SEQ ID NO: 2255 - DNA, 23 bp, Artificial Sequence
  Description of Artificial Sequence: Synthetic oligonucleotide
cccaaaaaactactaactcctaa

SEQ ID NO: 2256 - DNA, 28 bp, Artificial Sequence
  Description of Artificial Sequence: Synthetic oligonucleotide
ggttgttgtttttcgttttattatttgt

SEQ ID NO: 2257 - DNA, 29 bp, Artificial Sequence
  Description of Artificial Sequence: Synthetic oligonucleotide
gggttgttgttttttgttttattatttgt

SEQ ID NO: 2258 - DNA, 17 bp, Artificial Sequence
  Description of Artificial Sequence: Synthetic oligonucleotide
  modified_base (7)..(7): Inosine
gaatttnggggaggatt

SEQ ID NO: 2259 - DNA, 17 bp, Artificial Sequence
  Description of Artificial Sequence: Synthetic oligonucleotide
acctaaaccccaccaaa

SEQ ID NO: 2260 - DNA, 15 bp, Artificial Sequence
  Description of Artificial Sequence: Synthetic oligonucleotide
  modified_base (4)..(4): Inosine
aggnggcggtaagtg

SEQ ID NO: 2261 - DNA, 17 bp, Artificial Sequence
  Description of Artificial Sequence: Synthetic oligonucleotide
  modified_base (4)..(4): Inosine
aggnggtggtaagtgtt

SEQ ID NO: 2262 - DNA, 26 bp, Artificial Sequence
  Description of Artificial Sequence: Synthetic oligonucleotide
  modified_base (13)..(13): Inosine
tgtagattttttngatattattattt

SEQ ID NO: 2263 - DNA, 20 bp, Artificial Sequence
  Description of Artificial Sequence: Synthetic oligonucleotide
taaaccccaactaacaacta

SEQ ID NO: 2264 - DNA, 23 bp, Artificial Sequence
  Description of Artificial Sequence: Synthetic oligonucleotide
gtatttgtttgacgggaaagaga

SEQ ID NO: 2265 - DNA, 24 bp, Artificial Sequence
  Description of Artificial Sequence: Synthetic oligonucleotide
ggtatttgtttgatgggaaagaga

SEQ ID NO: 2266 - DNA, 23 bp, Artificial Sequence
  Description of Artificial Sequence: Synthetic oligonucleotide
tttgggagtagtttattaggtaa

SEQ ID NO: 2267 - DNA, 26 bp, Artificial Sequence
  Description of Artificial Sequence: Synthetic oligonucleotide
  modified_base (2)..(2): Inosine
cngctatacccaaaaatataataaaa

SEQ ID NO: 2268 - DNA, 23 bp, Artificial Sequence
  Description of Artificial Sequence: Synthetic oligonucleotide
atagagagtgacgagtatgtgat

SEQ ID NO: 2269 - DNA, 27 bp, Artificial Sequence
  Description of Artificial Sequence: Synthetic oligonucleotide
tgttatagagagtgatgagtatgtgat

SEQ ID NO: 2270 - DNA, 25 bp, Artificial Sequence
  Description of Artificial Sequence: Synthetic oligonucleotide
tgaaaaggttagttagtaatttagt

SEQ ID NO: 2271 - DNA, 25 bp, Artificial Sequence
  Description of Artificial Sequence: Synthetic oligonucleotide
aatatttcctacctaactctaaaaa

SEQ ID NO: 2272 - DNA, 28 bp, Artificial Sequence
  Description of Artificial Sequence: Synthetic oligonucleotide
  modified_base (6)..(6): Inosine
tagttngttttttatacggttttaaatg

SEQ ID NO: 2273 - DNA, 31 bp, Artificial Sequence
  Description of Artificial Sequence: Synthetic oligonucleotide
  modified_base (9)..(9): Inosine
ttttagttngttttttatatggttttaaatg

SEQ ID NO: 2274 - DNA, 17 bp, Artificial Sequence
  Description of Artificial Sequence: Synthetic oligonucleotide
gggggataaaggagaag

SEQ ID NO: 2275 - DNA, 20 bp, Artificial Sequence
  Description of Artificial Sequence: Synthetic oligonucleotide
caaaatttccctcaatttcc

SEQ ID NO: 2276 - DNA, 21 bp, Artificial Sequence
  Description of Artificial Sequence: Synthetic oligonucleotide
ggttgtgtgttcgtgtatgta

SEQ ID NO: 2277 - DNA, 22 bp, Artificial Sequence
  Description of Artificial Sequence: Synthetic oligonucleotide
tggttgtgtgtttgtgtatgta

SEQ ID NO: 2278 - DNA, 21 bp, Artificial Sequence
  Description of Artificial Sequence: Synthetic oligonucleotide
atgtaagtagtgtggtaaagt

SEQ ID NO: 2279 - DNA, 21 bp, Artificial Sequence
  Description of Artificial Sequence: Synthetic oligonucleotide
ccacaatccttacattcataa

SEQ ID NO: 2280 - DNA, 28 bp, Artificial Sequence
  Description of Artificial Sequence: Synthetic oligonucleotide
tttatagggcgtttaggttttattaaat

SEQ ID NO: 2281 - DNA, 32 bp, Artificial Sequence
  Description of Artificial Sequence: Synthetic oligonucleotide
tttatagggtgtttaggttttattaaatatat

SEQ ID NO: 2282 - DNA, 18 bp, Artificial Sequence
  Description of Artificial Sequence: Synthetic oligonucleotide
  modified_base (7)..(7): Inosine
ggggatngaggaaatttt

SEQ ID NO: 2283 - DNA, 16 bp, Artificial Sequence
  Description of Artificial Sequence: Synthetic oligonucleotide
  modified_base (9)..(9): Inosine
aacccaaangccctaa

SEQ ID NO: 2284 - DNA, 24 bp, Artificial Sequence
  Description of Artificial Sequence: Synthetic oligonucleotide
  modified_base (5)..(5): Inosine
aagtngggttacgtatttttagtt

SEQ ID NO: 2285 - DNA, 26 bp, Artificial Sequence
  Description of Artificial Sequence: Synthetic oligonucleotide
  modified_base (7)..(7): Inosine
aaaagtngggttatgtatttttagtt

SEQ ID NO: 2286 - DNA, 22 bp, Artificial Sequence
  Description of Artificial Sequence: Synthetic oligonucleotide
gagaatttttattagggttttg

SEQ ID NO: 2287 - DNA, 19 bp, Artificial Sequence
  Description of Artificial Sequence: Synthetic oligonucleotide
  modified_base (9)..(9): Inosine
tcaacaacngctaaacatc

SEQ ID NO: 2288 - DNA, 28 bp, Artificial Sequence
  Description of Artificial Sequence: Synthetic oligonucleotide
  modified_base (15)..(15): Inosine
gagttttttagtttngcgtttttatatt

SEQ ID NO: 2289 - DNA, 30 bp, Artificial Sequence
  Description of Artificial Sequence: Synthetic oligonucleotide
  modified_base (16)..(16): Inosine
ggagttttttagtttngtgtttttatattt

SEQ ID NO: 2290 - DNA, 16 bp, Artificial Sequence
  Description of Artificial Sequence: Synthetic oligonucleotide
  modified_base (4)..(4): Inosine
agtngagggtttaggt

SEQ ID NO: 2291 - DNA, 18 bp, Artificial Sequence
  Description of Artificial Sequence: Synthetic oligonucleotide
  modified_base (3)..(3): Inosine
cangctattcacaaaaaa

SEQ ID NO: 2292 - DNA, 21 bp, Artificial Sequence
  Description of Artificial Sequence: Synthetic oligonucleotide
  modified_base (4)..(4): Inosine
gttngtcgtattttggaggtt

SEQ ID NO: 2293 - DNA, 22 bp, Artificial Sequence
  Description of Artificial Sequence: Synthetic oligonucleotide
  modified_base (4)..(4): Inosine
gttngttgtattttggaggttt

SEQ ID NO: 2294 - DNA, 16 bp, Artificial Sequence
  Description of Artificial Sequence: Synthetic oligonucleotide
ggagggtagggttttt

SEQ ID NO: 2295 - DNA, 19 bp, Artificial Sequence
  Description of Artificial Sequence: Synthetic oligonucleotide
  modified_base (3)..(3): Inosine
aangccaaatcataacttc

SEQ ID NO: 2296 - DNA, 21 bp, Artificial Sequence
  Description of Artificial Sequence: Synthetic oligonucleotide
  modified_base (8)..(8): Inosine
aggggttngtcgtagtttatt

SEQ ID NO: 2297 - DNA, 23 bp, Artificial Sequence
  Description of Artificial Sequence: Synthetic oligonucleotide
  modified_base (8)..(8): Inosine
aggggttngttgtagtttatttg

SEQ ID NO: 2298 - DNA, 16 bp, Artificial Sequence
  Description of Artificial Sequence: Synthetic oligonucleotide
tggggttgtgtttgat

SEQ ID NO: 2299 - DNA, 16 bp, Artificial Sequence
  Description of Artificial Sequence: Synthetic oligonucleotide
  modified_base (7)..(7): Inosine
gaaaaangcttcctca

SEQ ID NO: 2300 - DNA, 15 bp, Artificial Sequence
  Description of Artificial Sequence: Synthetic oligonucleotide
  modified_base (11)..(11): Inosine
  modified_base (13)..(13): Inosine
gggtttttcgngngg

SEQ ID NO: 2301 - DNA, 16 bp, Artificial Sequence
  Description of Artificial Sequence: Synthetic oligonucleotide
  modified_base (12)..(12): Inosine
  modified_base (14)..(14): Inosine
tgggttttttgngngg

SEQ ID NO: 2302 - DNA, 24 bp, Artificial Sequence
  Description of Artificial Sequence: Synthetic oligonucleotide
gggtttttgattttagtaatatag

SEQ ID NO: 2303 - DNA, 15 bp, Artificial Sequence
  Description of Artificial Sequence: Synthetic oligonucleotide
  modified_base (2)..(2): Inosine
  modified_base (9)..(9): Inosine
tngactccngatcta

SEQ ID NO: 2304 - DNA, 27 bp, Artificial Sequence
  Description of Artificial Sequence: Synthetic oligonucleotide
agatttttttttcggttttttgttttg

SEQ ID NO: 2305 - DNA, 28 bp, Artificial Sequence
  Description of Artificial Sequence: Synthetic oligonucleotide
agattttttttttggttttttgttttgt

SEQ ID NO: 2306 - DNA, 13 bp, Artificial Sequence
  Description of Artificial Sequence: Synthetic oligonucleotide
  modified_base (2)..(2): Inosine
  modified_base (5)..(5): Inosine
gngtngaggggtt

SEQ ID NO: 2307 - DNA, 20 bp, Artificial Sequence
  Description of Artificial Sequence: Synthetic oligonucleotide
  modified_base (2)..(2): Inosine
  modified_base (7)..(7): Inosine
cngaaangcctaaaaattac

SEQ ID NO: 2308 - DNA, 22 bp, Artificial Sequence
  Description of Artificial Sequence: Synthetic oligonucleotide
  modified_base (4)..(4): Inosine
aagngttaggcgtttatgtatt

SEQ ID NO: 2309 - DNA, 23 bp, Artificial Sequence
  Description of Artificial Sequence: Synthetic oligonucleotide
  modified_base (6)..(6): Inosine
ggaagngttaggtgtttatgtat

SEQ ID NO: 2310 - DNA, 19 bp, Artificial Sequence
  Description of Artificial Sequence: Synthetic oligonucleotide
  modified_base (3)..(3): Inosine
gangtaggatagtaggata

SEQ ID NO: 2311 - DNA, 19 bp, Artificial Sequence
  Description of Artificial Sequence: Synthetic oligonucleotide
  modified_base (5)..(5): Inosine
gaaangaaccctaaaaaac

SEQ ID NO: 2312 - DNA, 23 bp, Artificial Sequence
  Description of Artificial Sequence: Synthetic oligonucleotide
  modified_base (18)..(18): Inosine
tttttggatttttcgttnggttt

SEQ ID NO: 2313 - DNA, 25 bp, Artificial Sequence
  Description of Artificial Sequence: Synthetic oligonucleotide
  modified_base (20)..(20): Inosine
gttttttggattttttgttnggttt

SEQ ID NO: 2314 - DNA, 21 bp, Artificial Sequence
  Description of Artificial Sequence: Synthetic oligonucleotide
  modified_base (2)..(2): Inosine
  modified_base (4)..(4): Inosine
tngngattatttattgtttat

SEQ ID NO: 2315 - DNA, 17 bp, Artificial Sequence
  Description of Artificial Sequence: Synthetic oligonucleotide
  modified_base (7)..(7): Inosine
ttacctngaccctccta

SEQ ID NO: 2316 - DNA, 15 bp, Artificial Sequence
  Description of Artificial Sequence: Synthetic oligonucleotide
tgtaggtcggggggg

SEQ ID NO: 2317 - DNA, 16 bp, Artificial Sequence
  Description of Artificial Sequence: Synthetic oligonucleotide
gtgtaggttggggggg

SEQ ID NO: 2318 - DNA, 17 bp, Artificial Sequence
  Description of Artificial Sequence: Synthetic oligonucleotide
tgggttgaagttgttga

SEQ ID NO: 2319 - DNA, 21 bp, Artificial Sequence
  Description of Artificial Sequence: Synthetic oligonucleotide
  modified_base (5)..(5): Inosine
tcaangaaacaaacataataa

SEQ ID NO: 2320 - DNA, 23 bp, Artificial Sequence
  Description of Artificial Sequence: Synthetic oligonucleotide
  modified_base (2)..(2): Inosine
tngttgtcgttgttttttgttat

SEQ ID NO: 2321 - DNA, 24 bp, Artificial Sequence
  Description of Artificial Sequence: Synthetic oligonucleotide
  modified_base (3)..(3): Inosine
gtngttgttgttgttttttgttat

What is claimed is:

1. A computing platform for utilizing CpG cancer methylation data for generation of a cancer CpG methylation profile database, comprising:
   (a) a first computing device comprising a processor, a memory module, an operating system, and a computer program including instructions executable by the processor to create a data acquisition application for generating CpG methylation data from a set of biological samples, the data acquisition application comprising:
      (1) a sequencing module operating a sequencing device to perform CpG methylation by hybridizing at least one probe sequence selected from SEQ ID NOs: 1-1775 and 1830-2321 to an extracted genomic DNA treated with a deaminating agent, wherein the extracted genomic DNA is obtained from a set of biological samples, wherein the set comprises a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different; and
      (2) a data receiving module receiving:
         (i) a first pair of CpG methylation datasets generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
         (ii) a second pair of CpG methylation datasets generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different; and
         (iii) a third pair of CpG methylation datasets generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different; and
   (b) a second computing device comprising a processor, a memory module, an operating system, and a computer program including instructions executable by the processor to create a data analysis application for generating a cancer CpG methylation profile database, the data analysis application comprising a data analysis module to:
      (1) generate a pair-wise methylation difference dataset from the first, second, and third pair of datasets; and
      (2) analyze the pair-wise methylation difference dataset with a control dataset by a machine learning method to generate the cancer CpG methylation profile database, wherein
         (i) the machine learning method comprises: identifying a plurality of markers and a plurality of weights based on a top score, and classifying the samples based on the plurality of markers and the plurality of weights; and
         (ii) the cancer CpG methylation profile database comprises a set of CpG methylation profiles and each CpG methylation profile represents a cancer type.

2. The platform of claim 1, wherein the generating the pair-wise methylation difference dataset comprises:
   (a) calculating a difference between the first dataset and the second dataset within the first pair of datasets;
   (b) calculating a difference between the third dataset and the fourth dataset within the second pair of datasets; and
   (c) calculating a difference between the fifth dataset and the sixth dataset within the third pair of datasets.

3. The platform of claim 1, wherein the machine learning method utilizes an algorithm selected from one or more of the following: a principal component analysis, a logistic regression analysis, a nearest neighbor analysis, a support vector machine, and a neural network model.

4. The platform of claim 1, wherein the sequence device further analyzes the extracted genomic DNA by a next generation sequencing method to generate the CpG methylation data.

5. The platform of claim 1, wherein the methylation profile comprises at least 10, 20, 30, 40, 50, 100, 200, or more of biomarkers selected from the group consisting of Tables 8-41, and Tables 56-59.

6. The platform of claim 1, wherein the cancer type is a solid cancer type or a hematologic malignant cancer type.

7. The platform of claim 1, wherein the cancer type comprises acute myeloid leukemia (LAML or AML), acute lymphoblastic leukemia (ALL), adrenocortical carcinoma (ACC), bladder urothelial cancer (BLCA), brain stem glioma, brain lower grade glioma (LGG), brain tumor, breast cancer (BRCA), bronchial tumors, Burkitt lymphoma, cancer of unknown primary site, carcinoid tumor, carcinoma of unknown primary site, central nervous system atypical teratoid/rhabdoid tumor, central nervous system embryonal tumors, cervical squamous cell carcinoma, endocervical adenocarcinoma (CESC) cancer, childhood cancers, cholangiocarcinoma (CHOL), chordoma, chronic lymphocytic leukemia, chronic myelogenous leukemia, chronic myeloproliferative disorders, colon (adenocarcinoma) cancer (COAD), colorectal cancer, craniopharyngioma, cutaneous T-cell lymphoma, endocrine pancreas islet cell tumors, endometrial cancer, ependymoblastoma, ependymoma, esophageal cancer (ESCA), esthesioneuroblastoma, Ewing sarcoma, extracranial germ cell tumor, extragonadal germ cell tumor, extrahepatic bile duct cancer, gallbladder cancer, gastric (stomach) cancer, gastrointestinal carcinoid tumor, gastrointestinal stromal cell tumor, gastrointestinal stromal tumor (GIST), gestational trophoblastic tumor, glioblstoma multiforme glioma GBM), hairy cell leukemia, head and neck cancer (HNSD), heart cancer, Hodgkin lymphoma, hypopharyngeal cancer, intraocular melanoma, islet cell tumors, Kaposi sarcoma, kidney cancer, Langerhans cell histiocytosis, laryngeal cancer, lip cancer, liver cancer, Lymphoid Neoplasm Diffuse Large B-cell Lymphoma [DLBCL], malignant fibrous histiocytoma bone cancer, medulloblastoma, medullo epithelioma, melanoma, Merkel cell carcinoma, Merkel cell skin carcinoma, mesothelioma (MESO), metastatic squamous neck cancer with occult primary, mouth cancer, multiple endocrine neoplasia syndromes, multiple myeloma, multiple myeloma/plasma cell neoplasm, mycosis fungoides, myelodysplastic syndromes, myeloproliferative neoplasms, nasal cavity cancer, nasopharyngeal cancer, neuroblastoma, Non-Hodgkin lymphoma, nonmelanoma skin cancer, non-small cell lung cancer, oral cancer, oral cavity cancer, oropharyngeal cancer, osteosarcoma, other brain and spinal cord tumors, ovarian cancer, ovarian epithelial cancer, ovarian germ cell tumor, ovarian low malignant potential tumor, pancreatic cancer, papillomatosis, paranasal sinus cancer, parathyroid cancer, pelvic cancer, penile cancer, pharyngeal cancer, pheochromocytoma and paraganglioma (PCPG), pineal parenchymal tumors of intermediate differentiation, pineoblastoma, pituitary tumor, plasma cell neoplasm/multiple myeloma, pleuropulmonary blastoma, primary central nervous system (CNS) lymphoma, primary hepatocellular liver cancer, prostate cancer such as prostate adenocarcinoma (PRAD), rectal cancer, renal cancer, renal cell (kidney) cancer, renal cell cancer, respiratory tract cancer, retinoblastoma, rhabdomyosarcoma, salivary gland cancer, sarcoma (SARC), Sezary syndrome, skin cutaneous melanoma (SKCM), small cell lung cancer, small intestine cancer, soft tissue sarcoma, squamous cell carcinoma, squamous neck cancer, stomach (gastric) cancer, supratentorial primitive neuroectodermal tumors, T-cell lymphoma, testicular cancer testicular germ cell tumors (TGCT), throat cancer, thymic carcinoma, thymoma (THYM), thyroid cancer (THCA), transitional cell cancer, transitional cell cancer of the renal pelvis and ureter, trophoblastic tumor, ureter cancer, urethral cancer, uterine cancer, uterine cancer, uveal melanoma (UVM), vaginal cancer, vulvar cancer, Waldenstrom macroglobulinemia, or Wilm's tumor.

8. The platform of claim 1, wherein the control dataset comprises a set of methylation profiles, wherein each said methylation profile is generated from a biological sample obtained from a known cancer type.

9. The platform of claim 1, wherein the biological samples comprise a circulating tumor DNA sample or a tissue sample.

10. The platform of claim 1, wherein the at least one probe comprises a sequence selected from SEQ ID NOs: 1-1775.

11. The platform of claim 1, wherein the at least one probe comprises a sequence selected from SEQ ID NOs: 1830-2321.

12. A computer-implemented method for generating a cancer CpG methylation profile database, comprising:
 a) hybridizing at least one probe sequence selected from SEQ ID NOs: 1-1775 and 1830-2321 to an extracted genomic DNA treated with a deaminating agent to generate CpG methylation data, wherein the extracted genomic DNA is obtained from a set of biological samples, wherein the set comprises a first cancerous biological sample, a second cancerous biological sample, a third cancerous biological sample, a first normal biological sample, a second normal biological sample, and a third normal biological sample; wherein the first, second, and third cancerous biological samples are different; and wherein the first, second, and third normal biological samples are different;
 b) obtaining a first pair of CpG methylation datasets, with a first processor, generated from the first cancerous biological sample and the first normal biological sample, wherein CpG methylation data generated from the first cancerous biological sample form a first dataset within the first pair of datasets, CpG methylation data generated from the first normal biological sample form a second dataset within the first pair of datasets, and the first cancerous biological sample and the first normal biological sample are from the same biological sample source;
 c) obtaining a second pair of CpG methylation datasets, with the first computing device, generated from the second normal biological sample and the third normal biological sample, wherein CpG methylation data generated from the second normal biological sample form a third dataset within the second pair of datasets, CpG methylation data generated from the third normal biological sample form a fourth dataset within the second pair of datasets, and the first, second, and third normal biological samples are different;
 d) obtaining a third pair of CpG methylation datasets, with the first computing device, generated from the second cancerous biological sample and the third cancerous biological sample, wherein CpG methylation data generated from the second cancerous biological sample form a fifth dataset within the third pair of datasets, CpG methylation data generated from the third cancerous biological sample form a sixth dataset within the third pair of datasets, and the first, second, and third cancerous biological samples are different;
e) generating a pair-wise methylation difference dataset, with a second processor, from the first, second, and third pair of datasets; and
f) analyzing the pair-wise methylation difference dataset with a control dataset by a machine learning method to generate the cancer CpG methylation profile database, wherein
  (1) the machine learning method comprises: identifying a plurality of markers and a plurality of weights based on a top score, and classifying the samples based on the plurality of markers and the plurality of weights; and
  (2) the cancer CpG methylation profile database comprises a set of CpG methylation profiles and each CpG methylation profile represents a cancer type.

13. The computer-implemented method of claim 12, wherein step e) further comprises
  a) calculating a difference between the first dataset and the second dataset within the first pair of datasets;
  b) calculating a difference between the third dataset and the fourth dataset within the second pair of datasets; and
  c) calculating a difference between the fifth dataset and the sixth dataset within the third pair of datasets.

14. The computer-implemented method of claim 12, wherein the machine learning method utilizes an algorithm selected from one or more of the following: a principal component analysis, a logistic regression analysis, a nearest neighbor analysis, a support vector machine, and a neural network model.

15. The computer-implemented method of claim 12, wherein the methylation profile comprises at least 10, 20, 30, 40, 50, 100, 200, or more of biomarkers selected from the group consisting of Tables 8-41 or Tables 56-59.

16. The computer-implemented method of claim 12, wherein the cancer type is a solid cancer type or a hematologic malignant cancer type.

17. The computer-implemented method of claim 12, wherein the biological samples comprise a circulating tumor DNA sample or a tissue sample.

* * * * *